United States Patent 10,233,495 (METHODS AND COMPOSITIONS FOR SCREENING AND TREATING DEVELOPMENTAL DISORDERS) - sequence listing, part 58

SEQ ID NO: 507 - DNA, 33862096 bp, Homo sapiens (residues 29,629,335-31,745,715 of 33,862,096)
ttgattgtaactataagtatgattaggataattcaataatgttcaagtataaataccatgctgcacagattggaaagtctcccttcaaggatctgttcacttttaacagagtagttgtaaaagtaagaaatagggcaggcaacttattgggaattcattatgtgtcatttaaaatacatttccttaatatacaatgtaaaggcatgattatcaggtacaatataactttctttcccacagagcatgactgaggttttaagatgatcttggtttttatattatatatagaatattagatattacataaatactatactttttaagctttaaaaatattagtgatgtcattattcttcagtgaagccagcctataacacagctttgcccaagtaaaactacagttaaaggcatctagactaaggcaaaagaacaggaagtttagtgatgctgcaggaagagggaaggctttcccagtacttctccctgtaccataaattttgactccattaagattttatcctgggctttcctttcttctcattctacccataccttaacttcaattcctcctcacattctgacaactctcaactctacatctctcaagtccagatctccccttgatctccatacttgcatgttatctcaccctattggacatctcctcatgaatattctgcaaccaccaaaagctaacactcccacacatgaactccttgcatatactcttctcacctacttctcaactccccaacttgcttttcctccttctctgtattttttccggtttcagcgaaaaacaaataatgattccctttattagatgtaattctagatatttctacttcctctatcatgtccttcatcatgttgcatctaatcagtcaatcactaattatttattataccttctaaatagttcttgattccaatcttttctctctctctccattgtctttactctagttaaaatcattactatatcttacctcaaatatgctatcagtttcttcactggcattttactctgccacatcccacctgtaaagcagctgcaatgtgttctctcaataacgaattggggcttcctgtctaaaattctctagtgattctttactgtccttcaaataaaagctctattcttttttttttttttttttttttgagatggaggcggagtctctctctgtcacccagactggagtgcagtggcacaatctctgctcactgcaacctctgcctccctggttcaagtgattctcctgcctcagcctctcaagtagctgggattacaggtacctgccaccatgcctggcgaatttttgtatttttagtagagacagggtttcaccaatttgcccaggctggtctcaaactcctgacctaagatgatccacccacctcggcctccctaagtgctgggattataggcgtgagacattgcgcgcagccaaaagctttatccttaatgtggcttaaaagtcccttcataatataagtcctgctggtgtcttttactccctgctctagctatacagaaattttattttttatttcccaacctacactgtggccctcttgattcttggccttaaacatgttgttcccttttactggcataatctcaattctgacttccttttattggctaatttacatttatcttcttaatgtagtggacatctcttccaagtggctacctctggcaccttctaagttcagggaggtaattcttgcatgttctttgaattttgtatttttttgatttgacaagtaaaaattctatcaagttagagcacgtaacatgatgttttaatatatgaatatgttacgggatggctaaattaagctatttatgcattccctcacatgacattatgttctttcttgcactttgtatgtgccataacatatttaatctcccattaatggtctgcatttactttagactatcaactctaatgagttcaaggattacggctgtcctgttcattgctcaataccagttcctagaatgaagcccaatagctttatttatgactgggtgaaaagtataaggagaaattttaatgagaaaaacagaaaactttaaatagtcaaagacgaaaatggatttacagaagaaattgtaaacaaaggtcaccactgctcagagatgtatcttttggacaataaatctatctgtttttgtattaaaagtgtcagaatgggggtgggacattatttggagaaaattttaatctctttctattaaaattctgtatccaagattggtgaccgaggctttgccctatattccaattcaaacatagcttccttttgttctcagtcaaaatttcaactaaaatttacatcaggtaatttactatttcagataacagtgttcagggctataatcagagcctctattgcagaggagactggctgcagcctacccacagctcttccaaagaaatggatctctagtgataaaatttcagcattgtgacaggtggttggagaaaacttccaatcacagcgtgtaataattgcctagccaggtattaaatttggtccttcctctggctaaaggcaaaaacagtgtactctacaaggcacatctgtagattttaattgtataggatgtaatatagaataacattaaaccacatatctagcctcaaaattctttttagaaacctaactttttctattcatgagattctatgagctgaaaggaacagtgtggcttaagaaatgatggcagagttgacttcgggtgggttggctcttttcctggcctgacagtcaataagagaggctgatttacacagattccttgattatctcagtcattgaaaagacctcatgtcaatgcaagcttgcagaattctttcaactagtcatggcataagctgccttctatttctaaacatctgattaggcgcaccctgatggaatgtcaggcttatgaattttctgactttctgcccgcttgacctgtgctgtctcattgaatgaagtttgtagaaagtcttcaaccataatctgattttttgttgttgttccagaatactgttccgctgttgttttaaaatgttatttcatgtctttagctaatccacttagcagtaagaggaattatatagctagacagaaacagcaaatataaggaaagttagaaagacatcttttaataactggcgatcaatgacaaaaatataaaaatagaaaacaatcctagtaatggttaccaagaaaaacacataatatattttaacccagttttcaatgaaaattaaaactaagtaaaagttaacacaaattaattattttatatctttaaagtactatggaaatataaaataagtttaagaaaaagttttaagagtttaatgagttttgctggcaatgtaaagtcatctctacaatgaattgacagtttctcacatttccattttaaaaataatgtactaacctttgtaccacaatattacaaacacataaatcaaagtgtagcatgtctaagaaactctggaagagaaaactctgcatgtgaaataaaaaaccgaatattgaaaccaaaaaatgtatttaacatatgaatgcatgctttaaaaagccaaattagaaaaaaaatcatttaataatattttacaaaaaacacattcattaaaggagctaggtatcctatactatacttattaaactcaatacaaaaagcaattttactgcatttatgaggtgatgggtaagcttatgcttgcaaatggattaagaatgtgggtgcactgtttacaatcatctcgtaataagacacttttatttttggtgtttaaatactcatcattgtattcatcattgtgatgtagacatgtaaaacatttcaatttccagcagttttaaatattttcttctgagtaaagaaggatttttgccaatgtcaaaataaagccctcatttttatgagtgattttagtagtaaatgaactaacgaaaactaaatcccaaattccaattcaaataaagcaaagcaacgacaaagtcttgaagtttctgcttagggtagtgcattaattggccccaacctgactgtccgtaccttgcagaaagtagagcaatatggaatatgttttattttatagaaagtgtcttgggataggagtcctgcaagagatgtgctaaaaccaaatcctactcaacctgcccttcagaaactacagtggagacccatgagaggacattaatctccatttgacaaccacgcttcacttcacagagtttaccagtcaagttttctttcccagagtctcaacttcagtggaccaagcaacacttgcttcagtggatcaagcaatagttcagtggtccaactatttccttttagtgtttcttttttacctactaacaggttgcaatttgttcaagtgccaagtactaagaatactggtgggtgtatatcatttttgataaactatttcctcctgacctaactcttctatttaacttaagagcaagtgtgaaactgtcactatggatatgaatgcattgaattctatctgttgtcttagaattttgggtatagtcttaaactgaaaataacaagtaataagtctctctcattctaagagatggaaatagcagggcatagcaaagggcttacaaaagagctgggaaaactggccctgcctttgttgctccaccatacccacttatactaaaactctctgaaggttttagaaagaatcggtcttctgaattcatggcccagagggagagtagggatggctccctctgtttattccgtaagggggaaaagaagatggtacttcaacctttttgtcccatgcaagtaagtggagctccaagaccactgatcacagggtctgggagtccagagtagatagggatgacacctaattaccaactctgcttctgaagatgtctgcttcagaaattatatgcctacttgataggtaaaaaatgaatgagaaatgatacagtgaagaaggggggcagcctgtactccccagtgcttggtgtggcaaacgtttctcaataggtcaagtgaacgtggaagaagacagccatgtttgagctatctaccaggaacactctttatggagcaagagtacctcaggatcaagaggcttgaagatgtttttatagagcatattttccttcttaaagatggggaaaacaaaagagcttctgcaagacttcttaaagatcccatacttgtaccccaaataaacccgaactttgtatctctgttacacacacacacacacacacacaaatcataaactcaaagctacaaatagctagttaacaggagacatttgcctattttccttaactcctacttcccaagacattggagaataatataactgaagtgcagttaaaaaaaaaaaaaagaaaaagaggcagtggaggtgtaagatggaatctaaccacacttgccttccagagaaagtcttttagaccatggcttaagcttgagctggaaacaaggaagcatattaaattaaatatgacattgagattttaagctgaacccaattagatttaagtctttattacctcagaggccagaaagcaaagggatctattcatggcgccatctacctggatgatgtaaaagcatttcatgtttctgatctatctggctgaaactacgcatcaaactactaacacagtccacgaattcagcacttactcaaataaagcaaaggcaaaggagaatgatagacatccagatcatctagaatgtggtccagcagaagacagaaaatggtttacgggaggtctgaagagataaagaacttaagaaatatctgtgaaaaatggagcattatagtagtatcacatgattgaaaagctaagatagatatgttgatgcttttgtctcatgcaactgcaagttgcatgttttatatccgtctaccaacatacatgaatataaataatccacgtgaaaactattgctcctgtcaaatgcaacaacttgcctactgattggtaactttgctgaacaaccaatttaaattcctgaagcataattctaaggtctttaaagaagcatgccataaaagtatcaggaattatttaaggaccactaagaatgttctatttgtctcagaaattggttcttacaatttttagttgtttagaaccggcaagatgacagccttaaagaagttgacacttcaggagatcgaaaccatcctggctgacacggtgaaaccctgtttctactaaaaatacaaaaaattagcctggcatggtggcaggcgcctgtagtcccagctacgcaggaggctgaggcaggagaatggtgtgaacccgggaggtagagctggcagtgagctgagatcgtgccattgcactacagtctgggtgacagagtgagactctgtctcaaaaaaaaaaaaaaaaaaaaaaaaaagaagctgacacttgaagcacacattgtattgtacacttgaaaaatctttgagattgattagataggaacactttattttccataatttcatatggtgttaagtaatagatcctttaaaagttatacaaaaatttccagatgtctagatatgcttataccagcttaatgaaatgttttccaaaaagaatagagttaggattttgaaaagggaattaaatggagattaagagaaaagcagagggagaagaggataatttacaacagaagaaataatttaccaatgctcatagctcatcacaagattcactttgttgctttctttgttttcaaattagttcatcctattttttcctaaagaaaggaggtctcacactgtgttccttggacaagaaagactaagtaaattaaaaccatgttgctttaacccactttaaatataactcttgtgaggggctttggtacagtggtttttcctgtggcatatttgttaatgtatttaatagggatataggcggtaaataattacaaagatgtgtacatgtctgcatatatatcctttaaatataaaataaagaaggttacattattcacgaaaggcttctagatttatgttttgttaatgtcactaggtttgaacacacctgggagaaaactcaaaagccgtgagcatggagctcctataattttctttaccaggaaagaatataaatgtgaaaactcttggtgtcatggttaataggaacttcacctgttttaggttttagcaggttactgaagttcttctgtgacctctgaaggaagcatacttgaaagtaacgtttgggaatcattttatcaatggaacttgacatcagatagccatcactttcaagtaaagcattgagcattgatagaatggtcaatgagctatagagtaatatatctaagacatttctggattcttgctgcatccatttatcctcatgggtagacaagtgaaattggtcttctgccctgacaggagcaaactgatgctttatttaagcttcaaaaagaaagtgaatgaagcattattcagtaaacataaaataagtctacaggattcatcatatccaagctttctcaaggtaccttcaggagccaccctaagtcagtgaaatttttccggcccaatggcgaggtactctttgactgcacatgtgttcatattattaaagtctaaactttaggcagtgaataatttattgatacaggaaataattaaaatatttaagtcgctgtctcctgatatggaatagtgagacagaatcagattctagggatgacttggtcagcattgagaccacatgttcaagcaaaatataaagtttatacatgagacaaaagtccaaatctggggataaaatcaagttggaaaagatgagaagtcaaaattagaaaaaatgtagctggtgcttctaagccaagtggtataggttaattagccaaatacagaagtacccaagtgagagagagcatactgaggccaattacagataggttggtggttgtgagcaaactagtccttacaatgtagatgaactagccagttgatagtcctcttaaataaggtcagtgatatccagtcagtacagtagtgtgacaaagatctcagagtgaaagaactttggaactcgttagtccctctacttaggaattcagactctcaggaaagaaactcaacacagcatctctggctttctggacttaatatgatgtatgggaagcaaattcatcacacttccttttatagaccaggtaaggatggccacacaggttgcctatgaataaaatagtttccaatcttcagtcaagcagtgtgaaatacagccttgataactagaaatggtgcttttctgatgtgcattagagatctctgctggattccttctactgtgatgtaggctcataatactctaaggccagtgttcaggttctcttggactacagtgccatggattttgccggcctctgtggtcaactgtaattcatattggttcgaacttgaaattgtatctgagcaactggaaaaatgctcctctctcctgggatgtctgggacgactggtcctttttcatcctacccaattacatgaagattaacaatatttatttatcacaaatactccagatgattgtcatggctctggagaagttgatgtgcaaggcacagtatgcttatggcttcctgtcatcttacttatccacactacattgaaaaagtcctcaggtctagctcagtcagtatctacattattgtgtcctaaggttattacaaggttttctaatattttgtcctccaagttgttaggatagacaagactgcagttttgtagaaaagaactcctaccaggatctttggctctgatatgattcatttggatgggatgtgcaccttgaacagcaggaacatggtgtatggaacagctgcttttccttctgctttcgaaacattctgtatagtgctttaggagtaggttgggagtgcagaaagatgactcgtgtgtttatatgagcatagggaacagataaacactggcagaatgatgcattacaatcgattccttgttacagactagggtcatctgccacaaaatgttcttacaatacattaagcttgctgaaatagaaataaactggttccaaacttcctctcttctctatgtcctcaccccacaatggcatcttctcatcgtctatagatgaaacccatcgtgctggaattatttggcatgggagaagaataaacaggtttccggtgtgacgctttaacttgtaggattgttaaacttgtcatacctcagatatagctgaagattaagatgtggacaatgcctacagccatgcaggactgcttagcatcttccccacaggaagtatctgttccgtcaacattgtggttcgggtgagggagagaggtaatatataatgaggatcctagtgatgccctttccgtgtcatcaaaaatctgctgcagtttcctagaaagcgttcattctacttcagcagggaactatggctgtgaaggaaaaccactttttcctctgcttggtttagttgttgaggaattggaaaggagcttcatttctggaatacagagatcatctatctgtcatgagcagtggttgggcaagaataaattactggtccacagtgggaatgaacctgacacataatgcaccttagcaaagtgcaccttatacatgtgctgataaaggtctatctagactggggttcacaaacctgaataatcatcagaatgaacttttccaaatacagttctcagcctcaattaaaatctactaaattagaaaatcagagggagtcaaaagtgggtatgtgtacaccaaagtccctatattcttctatctgtgtaattttggtgatgagctgaaattgagaaggtctatgaagaccgaagttagaaagaaaagatgtcttaaataacaacaacgaaaaataacaggtaagaaaatgcaatcagttgggcttacagcaaaaaagagcgaacagtagagtgctatgaaattggtattaatgctggtcagaatatacgaaacatagtgaggtagaaacagtaaggaaattctccaattttctttgatactttcaatgaaaaattactaataaatatatgcattttatgatttaaaagacagcatgatgaacttgaaaaatatttttattcctcattccatctagggacactggaatacactgcaaagaaatgttgtttaacattcccttttccatttatcattttttttaaaaaaataaacattttcagaaatttggcctgaatattaaataacagatttgattattcaatctcaagaatctatgaagtagcttgcaaagaaaacggttttaaaaagttgagagtggtaaaacgtaagatgaaagagagagatgaatatgtaccctcagaacagtattgtgtgttatagaaattaagtattagttgtcaatcatcatagataattaaagttattgacaagtttcattaacataaagatataaactcgaggaatttttctgaaaaggtacattgataaacttaaaagagaaacttcaatccaaaaatttatcactaaaatgctactttatcaatccatactactgatttagcttttacaactgattagtttttcggccttaatggttttcctttatgtattaactccctcttttgttattccaactttattattctttttttttttttttggtaggcccttgtagaaaagctattccaacttcagaagaaataactcaactatcaaattatgagatatttgaagacaagataccattaaatggatatgttaacactcattcacaaagatattaatgccctccaagagcaaacataatttgtctagagtgaatattaaatacttaaatattaatcatatattgaaatgcagtacatgattatatgtatacatatgtgcttatatacatgtatatataaatacatgcaagtatatatatgtgtttgtgtgtccctttgtgtctggaccccaaaaatgctaatattctataataggcatacagacgaacaaaaacatttaactactgttttatataatatttcggaaaagtaaatatgactgtccaaggaaacattattgattgaagtagggtaaattatatctaaaaataatggaattactacttacaaagaaaaaatccatgattcatggtgattaaaataagaattaaacacattcaccacagacccttttgtgaaggctatgtactctttcagttcctgtagctataaaatagagggtaactacatttaaaatacaagatgtattttaaaatattattaaaaacaagaatcaaggtaactcacacaattgatggtaggacaagaaaaatccctttctcaaataacaaaagaagatacatgaaatagagaaggaaaaatttctaatttacaaagaaaatagcatacacattcatgtctatttttcttacattaaagaggtctgggctattgagtttattatctatgtgtaaatattacacaagtgggtttcttcccctcaaaatgtaatcactcttgaccatttattcaattaatattattatgagaacaagttgcatagtccaccactcagctgaaaattgcagtcaccttgaacacagaggtctgccataatagtctgcttgcagtgcaatttttatataaagacaaaggttttttgcagagcattcaacctaggagaagtcaagattcaagatatccaatatcctttttactacttaaggaaagaaagccctgaattcaaagtatggaaagatgtaaacctagaagctatatccattattaacacactaagaataagattaaatttcacctttctaaatattaaagcatttattgttaattaattatcctcaatgaaatattttcaagtaatgataatctataaaagtgagcctaaattgttaactcccaaaccttatcaaaagcatttcaggtgtacaaataaccaaatgtataagatgacacccgaaattggcttcaaagccatgcaacctgtgcagttatgcagtaactcatgcttaggagagcccatgcttggtttaatgctctgctgttgccatcttacaatgcttaatttttgagtatgggacccagtattttctttcttccctgagtcccccaaattatggagccgatcctgacattttgggaaaaacagccaacagctaaaagactgacataaaaatctgaattaaattggttaagttagagagattgtaaaaaaaaaaaaaaaaatacatgaaattcacatttgacatactggcggtaaccagatgaatgacttgcaaatatgaatatagttggaagaagatacttcagactagaatcctagttgtttcagaatataatcaaatacaacctggagatgctaatcaaagataacgcaaagaaaaatcccttcgcttttgattttctatgcggctgtatgtgtgtggttctaaataaaattattttgcagaaaattacgggagaaagtcagataactgattatttccattgcgaataacttcattggctactactgagtccacgatattattctctaacacttctcctgattttaaacgaatctttaaaacaaaagagctcctattccaaatacttttcactctcatttcctcaatgacaccagttctcctttctcccaaccccctttaccgtgcagagtcctaaacaacctgaaaacagagttacctacttctcagggataaatttatccttggtggataaactttctcaaacttactactctccacctcagaacctccttgtattatctcaattttctctttcccacttccaaagtcaatccttccattttttttgctcgtgtatcctatcttgtaagactttgctcttatatattatgtctttctattggatcttcccttatactacaaacatgcttaaatttttattatcctgaaaatcaacaacacatcttttctgccctattactattcaatttcagttactggcctttctttctcattttttcatcatcacagatttattgtctctatttgccctgctcattttctcttttaccaaatcttaatctcacagttgttcctcctcactttggaacacagagactatatttaatgagagaaggagcaaagaaatacagctagtggaggcatcatgttagctgacttcaaactatactacagtgctacagtaaccaaaacaacacagtactggtacaaaaacagtcacatagaccaatgaaacagaatggaaagcccagaaataatgccacacacctatacccttctgatcttcgacaaagccgacaaaagcaagcaatgaggaaaggactccctattccataaatggtgctgggataactggctaaccgtatacagaagaataaaaccttacaccatatacaaaaatcaactcaagatgaatgaaagacttaaaatgtcaaagcaaaactttaaaaaccctggaggataacctaggcaataccatcctggacataggaatgggaaaagatgtaatgatgatgtcaaaagcaattgcaacaaaagcaaacactgacaaatgagacctaattaaattacacaacttcctcacagagttcctctgttgaactctgtcaacagagtaaacagacaaactacagaacgggagaaatattttgcaaactgtgaatctgataaaggtttaacatccagaatctctaagtaacttaaacaaatttattttaaaaactctactccattaaaaatgggcaaaggacatgaacacacatttttcacaagacgacacacatgtggccaacaatatgaaaaaaaatgctcaatatcaccaaccattagagaagtgcacattaaaaccacgataagatgccatctcgcaccagtcaaaatggctattattaaaatgtcaaaaaataacagatgctgttgggatggcagagaaaacagaacatttatacactgctggtgggggtgtaaattagttgagcccttgtggaaagcagtttggcagagctaaaaacagaacacagcaaccccattaccgggtgtatagccaaaggaatacaaattgttctaccacaaagacacatgcacacatatgttcattgcaacactattcacaatagcaaagatacagaatcaacctaaatgccctccatggtagactagataaagaaaatgtggtgcatatacaccatggaacactacgcagccacaaaaagaaggagttcgtgtcctttgcaggaacatggagggagctggagaccattctacttagcaaactaatgcaggaacagacaactaaatatcacatgttctcacttataagtgggagctaaataatgagaatacatggacacaatgagggaacagacactgggtcctacttgaggatagagaatgggaggaaggggaggatcagaaaaaatacctatcaggtagtatgcttattacctgggtgatgaaataatctgtacaccaaccccccatgacacactgtttacctgtataacaaacctgcatatatacccagaacataaaagtaaaacaacagctagatctgttgagaccatctttcagatctgctaagagaaaggctggtaaagaaagacaagaatcaaagttcattttaaaagttttggtatgagaaatttcaggaatgagatggcattaacagaggtggagaaaacggtgttgggtagctttgataggagctgtcatctgagtatgttaagtttgagtagcctatgagatatccaaagagaaaaatacacaatagaaggctggatatatggtctgaagttaagggcaaaagtctgtgccagagataatattttgggaataattagcatgtaaattttatttaaagccatgacactgcataaagtattataaagagtgaatatagaaaggaaagggagaacattaagcttaaacactgtttcatacacacttggatccagttggccaataatttgtttcagaacttttccttattaatttatgactgaaattggcatggggttttccttcctgtttcatttttgtctgattttggtaaaaaaaaaaaaaaattttctaaccttatattttccagacatgtatattgccttgtatgttctactgagtttgttgatgactggaattatctattcctagaaagtgtgttcaaatttgaatgtaaaataatttcagtctaatatagtctttgtaggaagacttttaatttgtgattaaatttctgtctcctcaggctttctatatccccttccatcatttttgtagcaatattctcctagaaattcatccatttcatgtaagtttctaaacttatttgcatagcttttagtattttctgtattttaaaaatatattataactgtagttataacattttcatccttaagattttatatttgtttttacttccctctcagttgatttgtctaattaaaacatgaatatgggcatttaaattttattgattccatgttgtttttatttatttctgctcttgaattcttctctttccatttactttctctgcatttattatacttttccctattttcttgagatgggcagttagctcactagttttcagcccttccgtctcttctacaaaaattaacaggaaccaattagttttaatttttatttttattatcactcggttctatgaattttaaccatccattttgaattcatctttgatccacaaattatttactttagtcaagtttttactattgattctagcttgttacaaatttaagagtatttccctaataataccaaatatgtgaaatgtattgacatttccatgtacttcagatgaaatttacactctgatttggggttctctatacagtctttatatccaccttatcaactgttaatcatcactatcttcactaacttttgtctggtgtcttgaaagaaagaggcattatgaaatctcccaccatgctgatatagttgtgtatttcttcttgttattctgtggatttttgctttacgtgttttaaaggtattttcccaggtatgtacgagatttttttgtttcttttgacagagtctcactccgtaacccaggctggagtggagactgcaatctcagctcactgcaacctctgcctcccagattcaagcaattctcccacctcagcctcccaagcagctgggactacaggcgtgcaccaccacagctggttaatttttgtatttttagcagagacggggtttcaccatgctgcccagattggtctcgaactcctgacctcaggtgagccacccacctcggcctctcaaagtgctgggattagaggcgtgagccaccatgcccggccaggtatgtacaagttttagaactgttatattttactccattttttgcctaataatgataatgaccataatgtctattttgctggaaataaattaggtgtctaagctttttattgattaatccttttcggaaaatctgtttccattttcgatatatgtgtctttatgtatttcttaaaaacaatgtattttgaattttgatgctttattctgaaaatttctacatttatatattaaatgtattgagcaaatagttctaggactacagatgtattttttttttctttttcttttctttccttttttttttttttttttgaggcagagttttgctctttcacccagtctggagtgaaatggcatgatctcagctcactgcaacttccgttccctgggttcaagtgattctcctgtctcagcctcccgagtagttgggattataggcacccaccaccaagcctggatacttttttttgggttttttttttttttttttttttttgtatttgtggtagagaccaggtatcaccttgttggcagcctggtctgcctgccttggcctcccaaagtgctgggattaaggcatgagctaccacgcccggccgctggtatttttctaccatctatttttttctatttctatttttctaccatcttttcttttattttatgctcatctcacatttttctgttttgttttccttctttcttgctttactgcgtactgattgagaactgttccttttatcattctttgattgtttcccaggtggatgctccattagtggttatccttgacaatttattacagcataaagtcgacatttaatcactatctctaccctctttctaaataaaagggcttgtggctgtaactcccctccatattgtttttaatctagtattttagatcaacattattttaaatgaaattagatattcttatatattttttgcaacaaatgccttttgtatttaaaagcttaactattttttcatcatacttattgcatctaaaacctttaaaacttatttttctactacttctaattcttcatacttattttagacatttttatagtaagggtctattggggtaaaatttcacttttttttcactctgataatgtctaatttcctcttactctgaagaactaattttgttgagttcagaattctaggttgacggtaattttttcaatatcttgaaaatattttccattgcttttttattcttattcattgttgtagataagaagtctaatgacagcctaaatttaattgctttgtaggttatccatctcacctctagctgctaatataaatttgtctttggatttctgcactttcactgtgatatgtctgagattggatttctatttatttactttgcctgttatataatgtgctttctgtttaagtggtttatgtcactggctcttggaaactttcctttaatatccttcatatattactccatctccatttctcaaaaaaattatgacatacaagaaagctgtatataattaacatacacaagttgctgagtttggagataaatatacactgataaaaacattacctcaatctatgacataaacctattcatcatctccaaaactttcctcctattctaatattattattattctgtaacagaacacttaacataaggtctatcctcttagcaaagtttaagtaaatagactaactataggcaatatgctttacagtagatctctaggaattatctatattgtataacctaaacattgtacccttttacaaatatctctccatttttcccttcccctagcccctggcaggaagcattccacattctccttccattagtttgactgtattagattcataatatgattgggatcatgtattatttgtctttctatgtctggcttacttcatgtagcataatgtcctccaggtttatccatgttgttacagcgaaatggtaggatttgcttattttttaagggctgaataatatttcattgtatgtatatatcacattttctttttcctttcacctgtcaatggacatttaggttgtctctatatctttgctattgtaaataatgctgcaataaacaatagagtgcagataatctccttgtgattctcattcaatttcctttggatatatccctagaagtggaattgctggatcatatagtaattctatttttaattttttttttgaggaatctccatactgttttccatagtgtcagcatgaattaacattcctgccatcagggtacaaggggcccttttctccacattcttgccaaacttgtcatctcttgattttctttttaagtaactgccattctaacagatgtgaagacatatatcattgtggttttgatttacatagccctgatgattaatgagtttgagcaccttttcatatatatgttggccatatgtaggtcttcattgaagaaatgccttttgagctcaactgctcatttttaaattgggttatataatttttttatattgaataataataatctccattttctttattctcctctttgaaaactcccattgagataagttatatgttcatattctactccccacccctgtatctattacctattgttcacatcttccacctccttagtttttggtaacacagtctgtacattctcttttagttttcttttaaatcatttctttcaactaatatgtttatatatgatatattcattttctaatttttaattgtagttgtttaattttgatttctttattccatttttacaatgttttcttttttataacttcaataacatttatttctataatattttacctatttattttatactatacatcttgcaattctaatatccggaattctagaagtaaactcaccgttcgttgtataggctgactgtgcttcatgagggcttttcttgtgcgtgtgagtgagtgtgtgtatgtctatgtgtttatgatgagctcaagttcccctgagtttaatctgtgaggacactgagggcacttttcatggtaaacaatttgcatttgcttctaactaatgctaggacgctcctaacctggtgctaccctgacttaatcacttgtttggatatttctttaccctttgtgataatatacactcaagagttcctcaccttacaagaataggccaacacacattttcaggtgacattattataattattctattactttgcactcacagtgagaagacagatgtctttttatgtttgttctctctgcagatagaattctctctgcccattatcttactgatagaaccccagttttatgtggaatctgtgtttagctccaccattttcgtgagccagaggatcatatttcttttccatcaaatgacttaattcacctaaaattggggttcccagtcttagcttttatctccaccatacaaatgtcagtggtcataggcatgttacggcatgacttcagtttcatctgatttttttcctagcctttaaaggtttacttatacttctttgaaagcaacataaaatacaactactagacattttccagcatcctagtgctttccagagggcattacagaagacttagctgtcctagcccttgagaacagaagtcagccctatcacaacaactgtgaagtaagctaatcaaatctatttcataaagcaaatgtgggatttaagtttgatgttgcttctaacggcttagcaaaaggactgacgtaaaactgtgctcaaaaagtaatggcttttactattattatagacagatattgtctacaaaacatattgacaaattaataaagcataatatgccacttattttcctagattactttatagtcttccttcaagcaatgttcttccgttctggtctatctatgctaaggtagatgtgacactgagggaaaaattcaaagtcataattaccaggaaaaattaatacggccctctctgagtctatcataaatgttactattacagaagaattaaccaatttagattttgtccctttcagtaaatttgctatttcatgtcaggcataacaacttacagacatctttgaaagggactgaaatacgggcattaataagccacgaaagaggtgaaataatcactcatcaagagaagtggtaaaggctttggacttctcaatgtgtgactttaatatttaagactctaaattttattttaattagtcagccataatacttttaaggccatgttttaagctttccttaaaaacggggaaactcgttaattgccatattcacttattagcagagtttttatttttaatatatgaaaagggtcacagagattggaggtagtgtagccaaatggtcacgtgcctaggcttcaagtgtaaagagatgggtctaaatgctcaatagctttttcctagggcctttaatatcctttcaatttctgtagaatgggaatatgaaaaaccatatatcggccggatgcggtggctcacgcctgtaattcaagcactttgggaggccgaggcgggcggataacctgaggtcaggtgtttgaggccagcctggccaacatggtgaagctccatctctactaaaaatacaaaaattagcctggcgtagtggcatgtgccagtaatcccagctactcgggaggctgaggcaagataatcgcttgaacccgggaggaggaggttgcagtgagctgagattgcacccttgtactctagcctgggcaacagggaaagactccatctcaaaaaaagaaaaaacaaaaacaaaaaccaccatgtatcataaggctattgtgagaactaaatgagaaaatgcatatctgacaattaaaagggtacctgagcctctgtaaccaaatactattaccaatattattattcattttgttgtattactaaatcatcttctgctgcttggttaccctgttagagaataaagctattacaatagttgtaaaaatgatatgatttggtacgtctgttggagatgttgcctggtttgctaaccatctttcaaatcattactgtgagtagaaaatatagtgctatatgattatcaagaatgaaagatgccttttgaagtgatggaaataatttattacttatttgaatgcaaactcacactctgaaattagggatgggatctagcaaatctcttttaaatattcataggcaataaaagtctggctgtttgactgatttaacaggcaattgaatgttaccttagttctgcataattgcagctataagaaacattaggtaggtgatataaaaacctcacaaacctctgacataggcacttaattgattttaaaaaataggttaaggctcatcttcaaattaaaaggcactttgtttattaatagcaaatctggctgaggcaggagaattgcttgaacccaggaggcagaggttgcagtgagccaagatcgtgccattgcactccagcctgggcttcagggagagactctgtctcaaaaaaataaaataaaataaaaatagaaaataaccacaaaataaaaacttttttgtttaaccaaccaaaaatcaagagaatcatggcctaaaacaaattcagaattcttgattataacacattaatgtacaacaagaattttttaaattgatttaaaaactcagttactgtaatcattttgtttcttcagcctctcagataatttatcccaaggcttattctactgcatcgaaacaacagtctttttaactagatagtggaaatatccaaaggattgatttagctaataaattattaggtgtgtcttttttacctaagtagtttgaaattgatcaaagtgctgagcaaagcctgagaaatacaaaagtcctattactacacattgttttaatttaacattgtatctttcaggtctaatcagcttatcacaggctgatacaacagaatttgagaaggatattatgtttaacatgatgtggttttcatgaaagccgtaaaaactaaatatgctttattttcattgtcaaataactcccaggttattactggccaaatatgtaatataaacacagctaggactgataatagtttcaagtttacttattttagatttattgttattttaacactctgcttaatcattgaggtacaagtggagagcttctgattttaagacttagagggtgataaaaatcctttttatctgtcttcacattttatttaactaatggaggcatgtgcatttcattatatttcatattgcactatctgcatttatttaccaatcactgccctcagtgggatatatatatatgtatatttacatatttttaaatatatatttacatattttaatatatacttacatatatatatatatatatatatttacacccatacaaacacacacacacaatttttgagggctgatactctagaatatcatctagtcaaaataaaaaggctgatcatgtattaaatttattgaataatttattgaatatgtactgtgttcctggaaccatagtactttaagtgccgtattttatattttgctcacaaaaaaaaccccctatgaaacaggatgaggaaacgtaagtttaaaactgttactcaaaatcacatagccagtgaattacagagggatttgccagttatcaattttttgcctttcaacatgatcctgtttttgacacgggaacatttctccccttgccagctgacatgatattaagttctgtcagtaaaggatgctggagtgacaatgggggaggtagaggtttgtctgtcccagtgtgcttttaattctttttcaaacctgtgactctgggctggcctatggaatgcccagtaaggctcacctcatccaccccactttacccagaagactttcagcaacactatgggtcgtgtttgacaagttctatgggtacccaataagcaaattgaggatgggtggcaaatccataggcagcttcctggagccccacctcatttcctcaagtttagtagcatccactacaggtagtttcccaccatgtccaatgaatacaccagacagctttctagcaaattcaatggttccccaccataggctacttccctgtgaattttgtcagcattcccctccaatattctcttcacactagcttcagctcactggctatagacttgttctggattgggtcaatgaaggaaacttctctgtcatcccatgggaggcagacacacactttctaaagaagtttgaatccagccttgggttgagctcctatctttccatattagttccttgtttgtgtactattcctcaggcttaaggtattctttagagatctcttttatttcctattaaaaattaatttccagtaagtagttaatacttatttgtgttaaaccatctctgtttaagtgactgagtggtttctgtgccctgtctggaccctgactactaatacaaggtgttattctagcccaagtttcaagtattttcttattcaaaagtttatgctttaaaaactcagtccagaaaataagataatacgtgttgaatcagggtatgttgctgaaatgaattattttttctttgggggaaatgtcagggtttataccaaaaacctttaaaatagaaggttataagtagttttgtgttaataaaggattgcaatataattacattaatagagttaataccaagatcaagttagagagtaagctattcctaaggacagaatagatgagtactgaaaaatgtcaaacactgaagttggatcttggccaggtgtatctcccagcactttgggaggccaaggcaagtggatagcttgagcccgggagttcaagaccagcctggacaacatggcaaaacaacatttccacacacacacacacaaataaccgggagtggcagcatgcacctgtagtcccagctactcaggaggctgaggtgggaagatcacctgagcccagggaggtcgaggctacagtgagccacgatcatgccactgcactccagtctcagggacagagcaagaccctgtctttaaaaaaaaaaaaatttgagtcttttcacagctaagccaaggtcagtttcacaatgacttttaattttttgatgcaactgctgtctcctacctgacactgatattcaaatagaaataaaaacacattccaattccatatcacaacccacattgaaatgatcttcaatttacttgccacatagcaatatctatttgactcagatccagcaatagtgcaacaatgatgaaggaccagagattgtttggaattccccttttccaatccccaattccttatgttgatttggataaaatatggatatgccacccaggattcaagactggaggtgctgctggtacatttgcagatatctgccctaccctcacatacttctcttcagaattggatagagaagaggttttcctactcaaggcgttccttttcaatctgtaagcatgtcaaaaggtccccgacattgactattcaataagtcattagtcaatggtttcatgcatactaccctagttactacccccccttattctcttttttctcttcatacgttatattatttgtttttatgtcttgcacattctaggaaatcagtaactcttccttaactaaccaatgtttttaagttatgaaggttagcaaatttttcctactcatcaaaccatagaaccatatctcacatgtagtagatgtactcagtaagtgaatataaaactaaacatcattataaaatgggttttcttcttgacaaataatccattcttaggagatagtatgcaaaacactgactaggagaaatttgctattttgttttagttttgatttgaaaaatcacaccatgtgtgatatatgaaaatttatctataagaaatgtagtgttatttatgaagaataaataatatggggtactaacagaattgcatgtattattagcagattacatgtgacataacaaatgtgtgtggaatggagggagaggaataaaatgagacagcgagagagaaaggatacccacacatactggtctatcttgagtaaggaaaagaactctgtggtcagagtaaccttcttgggatgtctcagttgccttttaagaatcctaacttacaatgtttttgtgaaatcacatgctataatacacatgtaaagaatttacccagtgtctggcattggattgtctctgaaacctgaaagctgagctaatatttaaactattgctcattttatctgagaggcctgtatctgctatacattaatgcaaattagattaaagagatttttcacttatcttcatacctcttcatgtagttccctccaacgagaattaaatgtctcaagttcctcattgattagctcatccatgactccgccatctgttagggtctgtgccaatatgcgaatctgatttgggttatcctctgaatgtcgcatcaaattttcaagtgactgaaacacatttgcaataattactatttctccttttttttctaaatacattggattatcagcaaatgctcagtatcttctgatttacatataattaagtcataatcaatttaaagcaaattttaattgggattaaaaacaccaaggagcatttttgcttcaaaaaataggatgtcattctatatgaatcttcatgggattatgacagtgttgcggactgagaacttaaaacttgattcacaaccacctttttccttgacgtcccctaactctaaaaccagaagaggtaaaacactaaatttctcaacttctctgatagctagtggtgtccacgtgacacaattctgaaaaagagtactctctcaagaagaatccttttgcccttcctacttttttgcacatacatggcctggaggtataacaatcatctttgcactgggaggcaatgactttgagtgtgaggtccttcatgctcaggaagagagagcagagagtgcctactcgcctcataatatggctgaaccatcctcaaccctgagtaacctcccttcactattcttttcgtggtgagaaaagatcattttgtgagcttaaaccgttgtctgattctctgttacgtacatcccaataatacccatctcctatactgctcaaaattgacaaagttgcctggctagataatatgatgaaagtgaatctcagtgtcataggcatgccagaaaacaagggattcaatttcatcttactggacctcaaacatatctataaaataagtgatgggcatatgttctcacaaatttattaaatcttctgttttccttgttttaaaaaaatgaaaatcttccaatacatatttgtaatttttcctgtttatgtatttttcttgaattttgagcaaactcaatacattgtcctattaagtttcaagaaaataaagagacttcctaaatacatttatattaaaaaaaatcactataacctgtaaaatactttaaaagccatcaaatttttgagtagaacaatgtgattgttaataattttcctaataatttatattccttattacttctaacaaatcttaattttgtaaatatttatttgcaaaatggatataaataattttaatggatacattattttataagtcttaacaaagtatataccttgttaaatttttttaaaggtggatgaaaagcaacaaagcaaaattaagggatcagttataaatatcttgagttgcaagaaaacctagaagtcgtgcagtttttctatccttgatacgtggtgatctagcccttttcactcaaaatgtcctcctggataagcatcagcaacactaccaaagagccaattttatgtatgtatttatttattttttcactgtggaatttcatttattggctccattatctgaattaggaacaatttgaaattatgaccacaacatagaaataaaagataagagcactcgcaattttcctcctccctgcttgtctgtgttgtgggcattgtgagggcctcgtctaaaatagtaaatagtaatggtaagttttgtttccccatcttttctaaatgctcttcattatggcttcaaattttctctctttccttaacattcctttgtgaacatgccctagtttttcagcacatcactgaaactgtgagagcaagaatttagcatggtgctccatgtacgatttgacaatttcataggctaacagcatcatcctatcttctgttctggccactgtccttttattaatgtgctgtaaatttgctgcaacttttctagaacatgtaacacattgctgattcacaagaaatgtttggtcaattaacttctctgaatacgacaaatttatagtcatagtcagatagagccaaaattaaagtccactggagatctacttcattgtactttaatatcttttcaggttttataatttccttttgaaaattaggaagttggataaaatgatctataggtgtctactctgatgttctaggattacaaattctattctgtctaaagaaataccttacattttcttcacatcttgaataatttatgctccttattttatagatttacagaggggctatactacttatagctttacgtacatatattacatattctaaaacaacatattcattacatatagataagtcaaaagtacactaaaatgcatagagcttgaatgattaaatgtcagaagttaaagtcaagtttataaatgcaaactcatttaattattgaaagtctccaaagtaaaacttaaaaatgtacttacattttatgaatactttaaagatatatttccaatattaaagcatatccatttaataactcaaaacattccgtaaggtgtaaatttgtgattttaagtaagtataaaataggttccaattcaatacgtgcagcttttaaactggaaataatatttcatattatcatcccgattagccctaaagcagtgagtttgtttattcacactgtctttgcaggtttgtggtacatttaattaggtgaagcatctatgtagaacttagtgatataataaaggcaaatttcctctgtgagaagccatttaaaccctttgcaaaatcttgtgacctagaaggttattagggggaacaaaggctttatccaaagtaccagtgctgagtgataacatagtaattatactctcttgggttgttttctttggatttgtcttctatttggtacttgacctcttttaatactgcatataaattatcatcatttggcttaatttacaacttacatctagcacctcagagatttcctcagctccgccaggaatgttttcagtggttttaagtttaaattctacttcatttagccacttgtttgctttctccaagtatgacaataactcatgccaacatgcccaaacttcctaagaaagaaatatatatcacagattaaatattatggtagaaaagtaaatgtgaaattttgccatttcattattaaaacttctgaaaatataacactttgtatttttcacctttactttgtagcaggtaattcaaaatgcagctagacagtttcatcatctaatacctctacaatcaaaagtcattaagaaaacattttattacatgaataatgaataaattcaaaagacagtaatttactttttaaaataaaaataagcaccaacattgcagtctgggaaacagaaaaataaaagcatatgtaaaaatgcatatgtaaatctaactccctcacacatcactgttaccagtattctgtgacctcctctgaaatttatcatatataatttgatagttaaaatttaagtgagtttaactatagctctcttttcactaaacattatatcataccattttctgtattactaagaagacatatttttaatgaaaatctaagacttctttaaagtggctctatcttagtttagcaatttcctttttttagatagactacttttagttttgtttgctattataaatttatggtaaacatcatcgtgaatatggactatttttccacattcttattatttccttgaggtatattatcggaaatattaccactaattcaaaggtttgattattttaaatggccattaatttgtattatgaaactgatttatacacagaagtactcataaaaaagcagaactttaaaatttctacaagaaaatatagaagaaaatatttctgactttggcatagagaagaatatcttaagtaagacatctcgtaaaaaactgaccgtaagaaaaaagagatgaatacattcgactacattaaaattaggaccttctattcatcaaaggacaccatcaagtaattgaaaaacagactcaaaatagaagaaaacaactgcaacatctgtaacacataagaatatgaaaaatgccagcaagtcaaatagaagatgaataacccaatcgataatgaaaagaaaacctgaaccaaaatcttaaagagaaatatgtatatacattaaacatgaagatatgttcaatctcattagtaatcaaggacatgtaggccaggattacaatgagataccatgttgattgacacaaatgagaagtttgacaattccacgtgtgagagaagatatacatgaacaaaaatttgtatttattgttggtgggtgtgtgtactgaaatggccatttcagaaaacaatttgttattctcaataaggtgaacattcacatacccatcaagacaacaactccactttttgatatgtgcatcctcagagaaactgtttaacatggataacaagactgttacaacaatgatcatttcagccctttttgtagtaatcaaaaaaaaggaaataatgtccactgcaaggagaatggaaaaatataccgtcatctttaaacagagaatacagacgtgacaatgaaaaatctcatcaaaaagaaccataagaatgaatctcagacacaaatatgttgggtgaaagacaaagccctaaaaaaactatattatagtttaccattactgtaatactgaaattaagcacaattgttttttcactcatatgtgtgtggattttttttaaacaaaggaataacaaaggtagctttctagatggtgattatgtctattggggaaaagataggaagatgcgagagaggataagaatgtaacaacggtcattttctgttagctttgtaactgttgaatgaacctataagtacagtaaacacaatgcagcaatcatcaccacttactaccacctgcccccgcctcactaccaccaaaattaaaggcttgaaaggaagatttatttcagaaggatctaaaaaattaatcagatttcccaaagttctctatgttcatagcccttagaatgacacagagtattcgatctctatctgatgaaaagtatcagtctcacctgcttggcaaacgtaccaacctttcatacctgcttgatatcttatgtacagtttattgcaaaaagtgaaattaagtgttttgctttaaaaggtgatagaaatctaaaatctgggtcatttccagctcctgctggactacaggctgtcttcattctgggcaaagatcccagtgggaaaatataaatatcttcttaaatacccgagggtaccttagagctttgaagacaaggagacgtgattggtaatgtgtcttattaactttggtgcagattgaggtaatgaactaccttgctgatttaactgtcagaatggatagcttcttctgtcctcaatgcatctgaaggacacagctggagaggctgaatgtaccagctttacaggtcacctttgcaaaataaaatatagtcttgaagcccgaattggagctaaaagccacttagaataactgttaagcttaacagtttggatcttaaaattactttgaaatcacagaatccaaagtggctttgaaggaaagtacaaataaaaaactaaacttctgttcaaaatagtagatggagctgatgaggtaactcccaacatatcctgcttcagttataccaaaatacatgttaaaatacaaaggaaacatttttaattcatagctgatctgtaaaacatgtatatagaacctcaggtgtgagaaagaaaaagagggaaatgaaagtagaaagtggaaaatcaagcttataaaaatactggcgtatcagaacagggtatacgacatcaaagctggggcatttaacactaacttgagatgggaaatgaggcaagccagggaaatgggaaagaatgaagcagtgtgccatccaccctgtaaggaagaagtagaacatccctagccattggaatattatgatttagcaaggaaactattgttgggggattttgggctgaaaaataaagatccacccataacaaacggaaacttaagcttgtatcacacatgagggcagagcataaaatctctacaatcctgatggcaacaatacaaaaactcaatagcccagagaaaaaaaaagacaaaaattccagtaaaggcaattcctattatagatgagctcgcaaataaacaaataaacaaacaaaaaccttactagccacatggggaaattcacttccattagagggagtcattagttgtaacaaatggtagaatccataccttatgacataaagataatagaacaattttggagaactgtacaataaatatgcctagcctcatggtgtatgtttcccatagagtttatttgcttgagactggcaagtggaattcacacctaagaaaaagggcttggttgcctacatttcattttgggagatcatctctttcttgttttcacaagccctggtttaaacagagagagctgacggagacttgaggggagtgaggtgaagagagtttgaatagttaggcaattcttctttctcacccttttatggggataggtagggtaaactcatctgaatcattttatttacaggatctaaaacaaaaccactcatctactgggtggatatattcaggaaggggtggttggtattcatttcctgttgagctgttggtatggccaagaaggaatcaaaaacaactctttcaaacttctcattcctgaaaggtacggagtataggtacttccagtgcccataggctctgagttgagatatggtaggtaaattagactccagggcatcactaaagcattggttaaaaagacataatattcaagagcagtttgtgtaaagctgttgacaagcgtcagcttgaaattcttgttaaacactacgaggtactataaaagcctaggagatcttttttggggggttcaaagctcatatgaataaggccaatctggatcctcaacagagcgaatcaagtctatagagaacgagccaggtcagtggtgataatatatagaagagggacaacagactaggcattatagatgtgtgtgggttttaacaaaagggaacagcagttgtgagcagcaaaaaaaggactttcacatgaagagagtatttttccctcttcaccctcccttatatcgacagtagatctgtatccagaaactgggatggaggaggagactgtgagaccatttattctcactcctgcgtctgtataaattgctgaagcaacagattaatctaaacttgtgaaatatttgattaagttatgatatttaaatttaaattagagtacattttaataactaaaagtgaataaaaagtaatgagatcccagagaaatattgttaaagaagccaactaccaggcagaaggtgaaatttgacagagttgggtgtagttattggaaaaataagacggtgtcatgtttattactcattaagttgaaacatttcagtcaaacagatggtatctgtttaagttgtttaaaggaatacatagaattaatcacaaaaaagaagaaaaccataacaaagaacagatttgtgaaacaactcaataaaatattgagaaatggaaaatatgttttttgaaaaaatataaacacacatacataaatgtagagagataaatatatatacagacaaagatgagactatttctctattgaaggataaattacgccacaggcagctgaagcgagaatttgagagttggaagacagattttagaaaagtatccaaaattgagcagatagagataagaatatagaaaatattaaagggaaaccagtaactggaatataagaaggggatagtcttaatagctctaagaaagttttcccttaggaaggaatgaagagattgggaaaaagaaaatcttcacaaagacaatgcagaaccactaaagaaataacgtatctgttctaattaacacaccaggtgacaaagtataaatgaaagcaaatttacacacagacaaagttgagtgaaactgtagaagacaaaatagggtgaaactgcagagcagacaggacgaagagaaaatttaaaggtaccagagaaaatgataaagaaacaataacttgacagcagatttcctaaaggcaaaaaatttcaaaagacaaataatattttcagtgttgtaggaaaaaaaaaaacctgtccttacataatttcctgctcaactgcatcattatccaatactcagggcaaaataaaggcattttcaatatgtaaaatctgaacacatttgctactcacactcaaggaaagagcaagaaagaaactgaacacagaagcaaagggaagaacaaaaggcaaaactgatcacaaaaactgggaaaatagcatcggtaaatctaaataaatattatatgaaatagttaaaacaacagcagcagcaacagcaattatatggactaatttgggggaaataaggtgaaaatgaaatatgaggcaacaataacgcggaaaacggaagaggtaggttcagagttaaactatgctaatgtttccaccatattattgttagagaggtatagagaaatatttataagataaaataaagtacatattccaaaccagtgaaaaaggactaaaatggaactcaataatttgataacttcaatatgaatagggaatgttagaaatgttattatacatgagaaggaaatggaaaaataatccaataattggtcttgaaaagtttgttattaatacgaaaacttaagaaaatcccttcggaaaatgtactccaatataaatttctaatgaatcacggagtatcatttaaatgaacaacatgaataatagggaacaatgatgcttatttaaggacattaagaacataagaaagtaatagtaggtgttttatttaaacattgtcagaaagcatttcctgggtacaaaaagtccctccctattgtaacatgttagtgaattaattgtggttttcttgagacatgtacagtgccatcagatcccttcccttcccattctttgttatattttatatagcactcacataacactgatacataagatacgtcattatatcctcagaaactgtaatatttcctgacatatagaaggcacttttcaagagtctgaggagtgaattgcatttaaaagaaaagaataaggatgagtaaagaagagcttagaactgataatggagaaactcggatcacattttacaattggaaaatgataatactgtattgggaatatatggggtactttagctacaaatacattttaaaatatttttaaaggtgtactttattattgatctgaatcgtatctttctttaaatatcaaaccctcaacataggaagcaaactaaataatgtttttcaaaagtaaagaggtacctgaacactttattaaccatattcaccaaaataactcagtctgtgtgagggaagggggcttaaagtccaactcatgtgcaatgtctggcagcatcagcatttgtagtggataaagttttgtgccccttggcacagtattttcataagaaaggtcatagcttatttttgatgcaattacatggccatcatttgaggcacctgctttctttatctaaattcagataagcataatctagacagtaaggcccatccataaaagttaaagcagaagttgtgataatacataaatataatgcaaaccatcaaaaaatatagagctggttaggtaacatgtctaacaaagaactctatggggcacggcaattactaaagacaattgtagtaaaaacatacttctctacagaatgcttttccccaaagatacttaaataagtttatgtacatacaaaaataagaaaaaataaagatcattgtctataaatctggagaaaatttataggattttatgacctaataatagtaatgagaattagaagcatagctactcacatatattgagtactaggctaagtagtttaaagagaatagctcatttaattttctcaacaacttatgaattatgtattatgtctagttgacagattgaaaacaggtttacacaagttaagcaaatggcccaaagtcatacaacttataagtgcctgaatgaggaattcaagccaaagttgttttgcactggtatccatgttcttaaccactatgcctcacatatgaccatgtattgacatatcattgacaaagaccaagaaaagcaactgacttccaaagtcttgcatttcccattcagcctagtgcagagccactggtagttggtggttagagtttcaagttccttttttaaggcctcttgtgctacaggtggagcttgagctatgacactatttacagactcagtaaggagtttcactttcgcttctttttgttgggcctcttctttagctctctgaaaaataaagaatgctctcttaatagcatgaaaataactttacatccaaaatgcatttctatgaatcatataatttctttctcacaacatcccagttagaatgagaattacaaaaataaatctaatatgaactccagtctcttccataaatttaagtttagttgaaattggaaagttaaagaaataatttattataagaatacaacagatctgtaacaagaatagactgaaaagtagtctgcatggaggtatggatttgtggtcaaatatatacacattgatataaatacaattgtttggaaaaggcaagaaacaaatatttcaatattaactaggttaaaaaatatttggcagtctagaattgaaatcacttataaattacttggatgaataatattgaaaccatcacaaatatcattatttaagttaaaggatacttaacatagaaaggtccccttgatgctatatttaggaacatattttgataaaagaaagtttcgttcgagaattgaaaacacatgagagaaagagaaaccaaaaaaggagctgctgatatcagaagctggcctgacacccagctatgccttggtcttctcaagtggaaaataaactgtttcacagaatttcaacattggaaaaggccactttgtttccataatggatcaagaccatgacaagatcattccataatcatgtctgaatccagacaaaaacatcaacattacccaaaccacaaaacgcccaacactctcctatcctggttaatatgaacgaacgccgtttctttattaattgcaactttagcctcattctggtcttctctccttctggacaagatacgatacccatatagctatccctacacactaatgacaagcaatccaaagtaaagcttttaaaccctccctcaaatcccctaacacaagcacaaatcctacaatgttttttttttttttcatccacacgcaccccctggcctccatgttgtgtattctccctcattgcaaaaaataatgaacccaacttgttcagctacaagagagttggtggtggtcttcggttgggagacatttacactccttaacttcaaatgcgtacatgtattttagaaacacacacacatacacactgtatctttagtctgtgttcctccaggggtcaaacctgacattagctttcaaatataagtagtttatttatgtgtgccatgtaaaagaaattctggtagctgaatggggaattgagacaagaaagggaagagacatccatatgggcatacttattaatcccagcaaacactgttaatgactagagtttaatcctgttagaaagccctgagaaatatatgcctgcgggttatcccattcaggggtgaagaaattggggtattatttctgtatcatcttccctaattgttaaaggctgttggggaaatgttaatttcccagtacttgcaagcctaccacacaagtgcaaaagtgggattcagtggccacagaaagccctcaagtaaaggaactcaggttctataatgtagaagttgggcctgcatacaatgcggtggttaaggtaagggcttattggcaggatatggataaggtcagctataaaatgcctttgtatgtgtcagcataatcaccctactcctttggatttagtcccacaattccttaaaagtatgcattatgtcagaaaatgcaaattgttttgtctatagaatgcttaacttcaccgattttaattgattgaaatctttagttcaatattctaaataaatcagctttttggcatcactgagcatagagattgtttttacacaaattgcattttgactttagtaattatagtataatcaacaagtttgattaccattcatcatttaatatgtgctactgtgttctgtgccagccatgtcataagtgctacctcattagatctttacccaaaccttctcggatgtgttttgttacctctatattggacattagaaaactgaggttcagagagtttaaggaaatcatcctcagagttatatcctctctttctcatagtttctgttaagcgggtctcaaatgttccatgagctgaagaaggagcatgctgtagtcagtctaatgaataaaattacaatttatgctcattataaataacccaagcaactatataaaaatgtagaatgaagaacacttctttccatggtttttagacttcatatattcttggtttaataagaggctcagatcttgggaaaggttcgaagaacaaacagcaaaatttattaatccaggtacatatgaggaaagaagatgatgatgaatttctctactaggagaaaaggtagaaagctaaatgactggtacagtttctatacaaatcctcataaaaacggtggctcttgtttctttccatgaatctaactatgatatgctctgccatctttcattgctaggatttcacacccgtgcttcttaaagtgagcacccttggaatcactctgcaacttgttctttggtatcaaactcaaacttgttaaaaatgaaaaactacaggcctcacccaagactcactgaatcagaaattctggggtcagggcccagcactctgtgtattaaacaagacttccaggtgattctgatgtccattcagatgcaggaatcactgctgtagtgattatacaaatttatttgtgtatttactattctcactttatgtgtaagttctggtaagcactagtactagagttataatagagtaaaaattaaaaaaaaataaaaccagttaataactttccagagtgtttttcaaagggttttagtataaagttttaccatatagtgattgctgatctccataaaagttttaaagtcagaggttgtttatcaaactgtaccctgggttcttttatgtcaaaaaaactttccttttcaggggaaaaataagttattaaaacagcacttccattttcaggtaaaacacaggaaagaacataaacagaagggggggtctctatttcttctttgagtatcagggagagatgtcaaaataggtctgttagtatcttctgacaataaagaaaaattagctatcaaatgagcacaggtagaagtctggacaaggtactattgctaacctccaggtagtgaagttgccttaaagaaactgtcttgagtagcaggctgaaaactcaagaaatgaaatcttcctgccaactcttccagtggttgttgccagaggcttccagagtttacctctttttactatcacccccatactaaaccaattttgtagctagaccaattatcaaaacatgtcaatcaatgtagacaaatttgttggaacactcatttcaaggatggttttcaaattttaaaaatttgagacagtttactctagagcacaggaaaataagagagatctgactgggttgttggtgacataggcaaatcgctcatagggagagggaagagggccagaagaggcactgaaccaaaggaacccagggataatcagagcagctgaacacaaatgactctatagtatctacttacggatctgaggtagtggccatatataaatagacgcagtgagaaaggaattgagatacaagagaaaaggccatatgagtgacacacaatggaaaagaaaggaaaggaaaaggaaagggaaagtgaaagtgaaagtgaaagtgaaagtgaaagggaaagggaaagggaaagggaaagggaaagggaaagggaaagggaaagggaaagggaagggaaaggaaagggaaagggaaagggaaagggaaagggaaagggaaaggaaaggaaaggaaaggaaaggaaaggaaaggaaaggaaaggaaaggaaaggaaaggaaaggaaaggaaaggaaaggaaaaaagagatgaaatagaataaaataccttcaatcctgtgggctctaccacaaataaagtctgtgactatggctaaatcatttgacctatctgggaattgcagttttctgataagcagagagagaagtgtgaattacacaagtttcaaagtaccttctagctctcacattctgataaagttttcctcaggggtgacctccccaaagtcaaattttaaattattttggtcttttgaaatactccaatggtttttcttgtccatttagaataaaaactgtgatactctaacaaaacccgtttgttaacagatatttgcccacctcctaagacttatctgaggtaattttatcccattttccttccttcaggcagatttctttctcttcccaattagcttcagggtctttgcagaagctatgctctctgaatagaatgtgtttccataaagatttttttaagtggttggcttttccttatgattcagttctctcatattacatacaattcttcataaatgctctataagtcaagtttttctaaaatagcatcctaccaccctcaaatcctgcctgaacattattcattcttgatttcaaaatccatgtttacttctaggcaaattatcatgatttcatttatttttccatttattgcctgctcctcaccacacgctagaacactagaatgtaaattccaaggcagtggtcttgctcaccaccctctatattcagtagccagagggtgtttggcacacagtaagtatgcaataagttttagttgataaatatgctattgctagattagaataattctgtgtttttaatactctagaaatgattatactaattttttcttcattatagttttatacacacataatatttatacatatttatggagtatattagatatttactttcaacatttgactaaagccgtatgacagattcgatatttaaacatctgagttttcatgtgagttactttctgctattaactataatagatatttctgaattaccatttaattatataattttttaccatgtggccctttcacaattaaaataataaataatgagtcatggtcatttatactgtgctaggcattgtgttagaaatttcatatttcatccctctaatgattctgaaagcagacattctgatacccagttcacaaacgaaggaatttggctcagtaagctcatgtaactcaccccaatttatacagttggcatggggccgaactaagttttaaactcaagtatctggctccacattgatttttccttgtcacaatccttgaaccaaaaaaagatctacagtattaatatttcaagtcattctctaagttcttgctagcacataaaaataataattatgattatagctactaattgagcaccaactctgagttaggcaatttactcacatggtagttacaatcaacagttcatacattcaagtgaggaagtatgatgatataaacatgataaaacagaggattatattgactattatattgttgcccaaggccatacgaaatgccactatgtaggttcaagtccaggcttcacctccaaatccatactacatactacataccagtttccttcgtaataagtcaatgttatattttgtcctattgtttcaagaaaagtacatgtaaactcagtcctttctatccatattaaaggctacgggttcaaatatttagtgtttccaaattctcagaaatgccttcaaactaccaaattaacacagtttgttgactacattataaatttgtcttttcaagaatacttttgcacagtttcaacgtacatttacatcagctacagacagttaatgaaatgagttgattctgctctcttaatactacatgatttcaagggaaaattgtttcaaattgtgattttcaattttcataattgaccacaatgcattaaaattaaacagtttaaggttgttaaaatgtatattaaacttgaagctaaattaaaattattaattaaaaatcaacctcttctcttagaaccaggaaagagcagactgtatacaacttcaagcattgttgcatttctttctttttccatttatttcctttgttttacttagtttttctttttttttttttaccttcatctcttcaactgctttctgtaattcatctggagttttatattcaaaatctctctcaagatactcttcttcagcttgtgtcatccattcgtgcatctctgatagatctttctggaggcttacagttttctccaaacctcccttcaaggcctcctttctggcatagaccttccacaaaacaaacaaacaaaacacgattattgacagtgatgaaacattattattatattatttcatcagtatgtaaataacagaaagcttagatagtaatgataaagaagtaaaaagcttatatgcataagaaaataactcatggggatcagatacactcaatttcccataagtgtgaaaataagacatgtctgtttatttggcatacttaataaaatgaacgtattgcccgatgatgataattcagctgtttgtgtgacaatgcttttctgtgaatggagaaaaacaaggctttttaaaataatatgtttcagttggaaaagtaattttattggcatacatagaaatagttattctttgtgttctttcataatgttttactattttaaatattctaagaacttcataatcatgtatctacagaaactctcataaattaaaaagaaaaaacgaaaagtgcataaaacgtagtttggcaattcacaaagaagataatatatggcaatacatgtatataaaagatgttctaataccatttatagttaaatgattgcaaatcgaagtgaattaatgcattttcacatgttaagacagggaaaaataataattaataaagagcccattttgggcagggatgtgggaaaatcaaagtttttatacttgttgagggaaatatccaacataatacaaccttttagatagtaagatggcaaaacatataaaaatgttaatgtccacgaatctgagtcaactgctccattttttgagagtgaatcatgccaaccaaagtgtagagactaacatgtacaatatttaattcagctttaaagaccaaacatcttgaaaacaaacccaaaggtgctttcatgagagattaaattatgacatatatatactatgggatactgtgcatcacaaatacatctttactgaaatgaaaagtggctcaatataaagttttacgtgtaaaatgcaagttgcaaaagagtctgtctgtggttatagaaaacatctgctatttaaagcctcacgcatttttgaaaactaaaactttctacaatggactccattactcattaaccagaaaaatgcaaaacttaaaacatctaaaagaaaatcatacaccttgttacaaggcactctatagtattacaatcattatacatagtgcttttactttaaaaagtaactctattcaaaagatggtattcttctctctggttgaaacaacattatacattttaagtaacagagttttcatagtattaatatataatgcacagttttagtaaaatgaagtgttcatggtactttgcccaatagtaaatatgtgtagaatcactatcgcattgattttccttataatttacaaccattttgagcctaatatagataatacttcattttaggttctttacttacctaggtaaatgtagtacttgatctactacaatgtaaataaatgtttcaccctaacacatctagaacaatatgtcttgcaattgtactagaaaaggtataaatgttattttgtgcagtcaatgaacctataataaacttaagaaaacatgctgctatttttgctattttataaattaagaaatcctgctgctaaatttctacttagaaactctgctctgttataatcttttaaggcagttggtgaagctacaaaaatattagagggactaatggaattcagccaagacttctagtaaaaactatacattcacatacatactttgtgtgtgtgtgtgtgtgtgtgtgtgtgtgtgtgtgtgtatgtgtgtgtgtgtgtgcacgtgctcaagtatggtgagatattgttggatcctggaaattttgaaggcaaaaacgacagcatttggtgatagatttgatgttcggctgtaagagaaatataggagacaagaaaatctcgtgggatttggcttgaataagtggaaagatggaggtgccatttgtaataacaggcaaatttctagggtagtagactggggtatacatcaggaattttgttttaacatgttagatttaatatgcctattattaattgatgtggaggtgttgagtgggcaaatgggtatgcaggtctaggatcattagaaagggtccagattgttaaaaaaaaaaaaaaaaaaaacttacagcaggaacaacttacagattacatttaaaactatggagcttgataagttgacccggagagtgggtggtaatagggggaaaaaaaaaaggagtccacagactgagccctggaacactttcaaatttagtggtcagggcaatagaaccaccaaggatattgacagtggtcagggaaaactaagagataattaagaaagaatgatgacacagaagccaactgaatttagcgatttagtaatacgaattcactgatgaccctgacaaaatctgctttaatagaatagtgaggataacagtttgattagctctcttaattggcatcaagagagaagggaaggagtgaaatggagagaaaggaatgtctgtaaagggaaacgggaatggagaggttgctagagagattgttgtccaattgaggattcttttaaatgacaggagatattacagaataattctctactgatgggaatgatgggaatgatgtagcgtggagaagatgtaggaggtagagggctgttcattagctgttacaatgtccttgtgcagagacaagggaaagggatccaggtacgtaagtggaaaagctggccttagacaaaagcacagaaagttcatctatgtaaacaaagggaaagtagagtctgtgagcttatatgcaggtcagtgggagtactgcaacttctattctgattgcttatattttctcggtaaaacaagaagctagttttttgcagaaagatggaaaaacagactgttagagatctgacgaaagagatctggggatcactacacccaaagagtatactgacccagagaaagacaatgatctgcaagctggcagaaagacatccacgtaacctctaaatcccatttattgataactatttactataaatttaaagccactaataattaaaatatataaccatatattatttacttagaaagtatacatgttttataattctatatatgtaggtttctatttgttttctatctaacaaacatgtacagtgattaatctaggttagatgaggctctatacaccttgaaaagatgaattcatttaattattatatacttatgaattatgtattaatatcatcacattttaaagattgggagactcaagcacaaaaaggttaaacaacttttctagaatcacacaggcagtttatgatgtggatagacttaaacccaggcgatctgatctcagagcttctggtcttacacactgtgcctttccatccacaaaaaaaatattctccagtatttgaccgcgtgtgtctggtttatttcacttagcatactatcctccaagttcatctatgctgctgcaaatggaagaattttcttttttaaagctacataatattccgttatatgcatataccatgttttatttatttgacaatatacatttagattgtttccatgtcttggctattgtaaatattgctgctgtaaacataggggtgcagatacctccttgagatcctgattttatttcctttggatatatatccagaagcgggattggtgaatcaaatgggaattctatttgtaattttttgaggaacctccaaactgttctcccaaatggctgcaccaatttacattccaaccaacaccataaaagaattcccttttctccacattcttgccaacacttagtatcttttgctttgttttgttctgataatagccaccctaacaggtatgaagaggttcttgtggcttttaactgcatttttcagatgattagtgatgcaccttttcatatacctgttggtcatttctacgtattctttagagaaatgactattcaagtcctgtgctcatttttaatcaggttatttttcagttttatttttgctattgaattttagaagttccttatatattttggatattaatcatttgccagacatatgatttgtgaatatttccttccattccctagaatctaaaatagtcaaactcacagaactagagagtagaatagtggtttccaaaggctgagagaggggaaaatggcaaaatgatgcccaaaggatacaaagcttcagttatgcaagatgaattagctctgcagatctactgtacaacattgggcctatagttaaaaatactgtattgttaaaaatattccaagaggatagatcttaggagctcttatcacaaaacaaaaaaaataaataaattaaggggcagaaggaaacttttggaggtgataggtaagtttatcatcttgaatgtggtaataagtctcatgggtatacgcttatccccaaactaatcaagttgtataaattaaatatgtacagcttttggtatgtcagtcatacctcaacaaagtggtttaaacaaaaatagattctcttccatctctaagagtttacgaattatccaatttgaccaagcattttagggatgggagcatggggaaatcttctcaataggcaagaaacagtatcttatatacatgttatctttatttttatgtacctcgtttatatgcccagtttgaaaagtgtacttgacttccagatacatgtctgattgtctttttctccgaaataaatatggctaagatggaaccgctagtcactctagtaagctattccattttgttcttctcttagtacccactctttctttaaaatcacaatgacctacaatgtagctcataacagaaatatatctgaaaacactttgattcttccctcattcttcctctagactatcaacaaacactctccttcagcaagtactgccagatctaatgggatctgttaaaaagaataaaggaatgtgtcatgttaggataggaataatacttctgggtagatgtaagtgtgaaagtcctcatcaaaaatgtaatgaggatactaatcctctgttggatgagtagtttgcaaatattttttcccattctgtggattgtcttttcattctgtttactgtttcctttgctgtgcagaagctagaaactcagatatcataaaaagaaaaataacgattttatgatataaaacatcatatcatatgtggatgtgatgggattcaaaaatgggcaaataatctgaacagttatttccaaaagaagaaaaaaatggccaattaatatatgaaaaaaaaattccacatcggtaatcatcaaataaatgcaaaccaaaaccacaatgaggtatcacctcaccccagctaggatgtatattgccaaaaagacaaaaaataattgttggcacggatgcagataaaaaggaactacactacactgttagtgggaatataaatggtacagtcactgtagagaacagcatggaggttcctcagaaaactacaatatccacaaatatcccctttttcctgcctgttttttttttctacctggacaattgcaatccctacctgcttccacttcagcccttttgatttattcttcttctaataggaatatgcagcaaacttaaaacaaccattttaaatgaaatgaaatgatgccactcctatgcttaaaagtcagatgactttccaaagtacttgacataatgactaaatcatcactgtggcttccatattcctttctgactcattttcccactctttttctcctggcttcctttgagctcctcaaacatgctaagccctctcttgcctcagatgttttctccacttcattttctggcagaattccttgacacaacaaattgtcaagttcctactactcgggtatcagctttaatttcgcctcttcagaaaacactctactgactacccaatagaaagtagttttcctgctcctgtcactctcatttaaagggttcttattgctacattcagagtgtaagcaagacttcaaacaagacattgttgtgataatgtgttaacctatttactttccattttcaccactaaactattatctccgtgaaggtaactacaatgtctattttattccctcacttatatctgatcatttttttagaaatagctagaatctagatttttaaacttatatacataccctttaaaatttaaaataataaccattttatatacccaaaattagatcatgggatgtgaaagcatcttcaaatgtatcagatatttggacaattttgtttcaaattatttatgttttcgcagacattggcatctggtgacaaaaaaggaattatctttaacccaaaagagtgtatcacacacttattttgtctgtagatatttctgtaatgcatagatttacacttcatttccattattctctctggaatgctgaattggtaacaatattcacatatggcttccttgtttttaccgcatcgtcttcttcttctccttgagcgccattgttccttccttttacaacctaactcatttggctacaaagtcagaacatggccagagtgatacttgtaggaaaagcacagatacatataatattctaagattagaaaatggagatcagaacatagcttggatctatagcttttttgctatgcaacagatgagtgtgtttaaaatatatctcttgaacaacaaattcttagtacatataacagacataaggtcttaagcaaagacatttttagagagcctttacaaattgtactcctgtaaaatgtaaaaaccttgaggttttagtaatattgttggttttatactttttttttttggctgatgttttccccttgctctacataaattggtgatgttctttttattcatccattaagaacattcaacaaacaaaaaacaaatacctttcacactggccttccaggaaaacatcaatggtataatctattatttaagtaatattttttttttttcctaaacaactcttctagcactgacttacttcaggagaagaatgtgagctagctgacccagggacagctcatctgtgaattaacagaaccaatgaacacttgtcagtgattgtattagctgagtgatttcccttgacttttctaattttttttttcattttcaaatgtagcttttgccttttgacattacttcttttctattttgaaagtttacttagcagtaaccaaagaccaactgcctctaacacgtaaattgaaaccccttattaatttccaaaaaggtacagtagttcccttgtatctttggaagatatgttcataccaagacctccaatagatgcctgaaaccatagatgatacctaaccctatatacactagattttttcctactcatacatacctataaaatttaatttataaattaggcatagtaagagattaacaactaataaaatagaacaagttatctctcttcttctccctctcaaaatatcttattttactgtgctcaccgattttaggattccaattgaccacaagcatttgaaaccagggaaagcaaaactgcagatgatcggggactaatgtattggtgaacttaaaagtattcattgctttagttcaaaattttatctttcgaacaagaagtatttgatatacactatttttgaatatatcttactatccgtaattgaatatttaaatataagagagatatctataaaatattcttctgtagaaaaatgagaaactcaaatatgagtgtacagtcattttgtgtgtgtttttttttgaaattcagctattcttaatggttactgaatcttaattgttatttaaaactagatgtcagccaggtgtggtaactcacacctataattccagcattttgggaggccaaggaaagagcattgtttgagcccaggaattcaaaaccagcctgggaaacacagcaagaccctgtctctaccaaaaaataacaaaaaattagccaggcatggtggcacacacctgtacttctagctacttgtggggactgagatgggagaattgcttgagcccaggaggttgaggctgcagtgagccgagttcacaccactgcactccagcctgggtgacagagggagaccctgtcccaaaaaataaaataaataaataataaatgtgtcgaagaggccaaacttggaaatgttaatcgaaagttataattatttatcctatttctacatacacatatattagccatgcattttattttgtaccaaatatctccgtgtaacaaatttttcttaatcccattattattatacatttatgttctgaagaaaacatggattggaaataatgactaagaataggatttcattttttagtatgacagttgtgttcaagaaagtcattttaggatcaaaataagatgaatgtgtactatttaaaatatataccatgaaaatatttagatatgctagaaaaaagattaatttgtcagaattaattgtgctttaaagcaaaaacataggaacaaagccttaaccaaaagtaacggtgaagggagacattaggaaatcttagttaagtacgttgaggcaagccacagtgaaagagattgtctatacctgttggcacatgtgatcccactgagtgttaagttctttgagttctgtctcaagtctcgaagcaaactctggctctgcttcattctttatcttctgcccaccttcattgacactgtttagactgggctgaattgtctgaatatcactgactaaaagctaagaaaataaatcaatttaagccagctgaaaaaaattactgccacatattagatatgaaacatagctagaaaatgtaaaattgggactgatggcattgcatatggatttttgtcttttaaaatctgagatacagagatattgatatagatgactgcctaacagtcttgcaaaaatgttcaatggttattatggcatgaatccagtggggaattatttgtattctacttatatcagaaacaaaaggaaataaatttaatatttctggttagaaaaatgtgtgaaaatgatgggcttcatactttattatctttgttagtattttcattttcaaacacaggatactgcagaaattgtttacagtgtaatgggtgtgaaggttatttgtgaggtggatttgcttttttagcttgtattgtaaaaaaatttccttaaagagcaagattgttttcttcctgctgcatgacaatggtataatgaatattatttcaaaatgcatactgtgttatattatagtacagtgcattatagatgaagagaacaacacagtatgaatagtaatttatcataagaaataacaagtagctcaaaggattctttacctttaaattatactgcattttatagtaaaataatgttatcaaatgaggttgagtacaaggcaatgttttgtcagttcctcatttactcaacccagggtttctcaacattggcactagtgacattttagattgtgcagttccttgttctggaggaatgttctatggactgtacgatatttagcagcatctctctcctctacctattagacaccagtagcatctaaccaccacccccaacccagctgtgacaatcaaaaacgtctagaaacattaaaaaaaatccactggggagaggagagcaaaatccaccccagctgtaaaacactgatctaaccaaataatattcatacaaaattattcatattaaaggcatcatataaaaatcttactctgcactgtttcagctgcttttttagaatttctgaatccccaagggcaggccattcctccttcagaaaaacatcaacttcagccatccatttcttcagggtttgtatgtgattctgaaacgagacccgttataaggcattactggtgtgctgattacttttaacacaattcatcattgtgttatgtctaaacacaggcccaaaaacaattcccatgtttaaaggatgtctctaagtagttcttgaggcaaagaatatttttactaagactgcatttttatggtctactgtatgagcactggtgtgtgaagtctgctattgttaaaaatacaaaattactaccaaatgtggttttatgatgttactctcgagaacattaaatcatatccccctctagagaaattttaagttacaaaacaactcatgagaatactaaaaatgtgtccttacagtacataaaacaaactatgaacaataaactcaatgtaatggtgtctttatagcctccctaaacccgaactttcacaaattattttctacagatgacagtttaaatagtccttccagttgggaacttttggactaatattttgtcatcttcaaagacagagcttttgcttttatttgtctgaccagtacgaagtaatgatcaggtaaaaatcatcatcttttatcatttataaatagccagtatctctcacccatgattctttcccgtattacctttttttctgctgttttgccacttctaaaaagtatgattcaactatgctgtctacatgtgttattttcttctgttttacttaaatttacattgaaaatatgtgctccacagaaagtttcccctttaatgtgattattaataataatttttaaactatttatctaagagaacttcaagacgatcaccttgctgttatctttcaagtctacatttgttcttatttcacatcttcactgtccttgttcaggtctttttttttttgtttgttttttgtttttttttttttttttttttgagatggagtcttgctctgtcgcccaggctggagtgaagtggcacaatcttggctcactgcagcctccacctcccaggttcacgccattctcctgcctcagcctcccaagtagctgggattacaggcgtgcactaccatgcccagctaatttttgtgtttttagtagagacagggtttcgccatgttggccagcatggtcttgatctcttgacctcgtgatctacctgcctcagctgcccagagtgctgggattataggcatgagccactacgcctgggctgttcaggtctcattagtgactccattaatgcactggctcgttttgatatctgcctcggtctcacctcattctaattactgatctacagtgatgccagtaatctcctctcctccttcctctcatcttgggaatgttttgaaaacacaagtggaatcatattatttccctctttaaccaatagcagttttttcttattaagtttttattgttattattatcagtcccatcaccactagattaaaactcagattgtaaaacatagcatccaaggacattcactgtctactctcaatccagttttccaaccataatattttattaatccccatatatattgtctacccagtgttgaacttatatcatttaactgaaaatgctgctatgctttctcaagaactctttctttctcggtattagctaactaaattctacctatttaatctatagcagagacaacctatgttccgataatatttcataatcctttttcctagtttatgttggatttccttcctgcctactgtgacaacctttcccatactgtttaatttatttaccatgcaaggctgaataatgctacccccaagatgtcctcaccctaatctctgaaacctgtgagtatattaccagaaaggactttgcagatgtgattacattaaggattctgagatggggagattatactggatcatccaccagggcataatgtaatcacaaaggtcctaattaaaaggaagtcaacacagggaacaggatagggaaaggaaggtgagaaggagaggtagaaagagagggagagggagatagacagggagagagaaattgacactagatgatgttacactgctgactttgaagatggaggatggggacatgagacaaggaatgcttctagaagctaaaaatgccaataaaacagactctgtcgcaaagcctccaaaacagacaaagtcctgctgacaccttaattttagcccactgagactaatcctgaacttttgacttccagaactctaataaatttgtgttgcttgaagttattaaatttccggcaatttgttaggagtgccataggaaatgaatacacctaccttcctccttcactagaatgtgggctccttgataacaagagccatgtaattgtgccctcttaggccactggtcttgacaaataatagatattttcatgcagtatttacataggtatgcatgtacacatatgtttataagtaaagaaatgctatgcattaaaaaatgttttaggtttgcttagtgctttggtttgtaaaaggtaagcacaaaaactaagcagctagactgggatttaaatccaggagcatattgttgcaatgtttttccatcataccataacgttttcgacatttccttcccagcattaacatttgtcacaataattgaccactcaagggacacattacttaccttattgaatattttaggcttttagaccttaatgcaattgttggtttactgtttttctttagcttgagtggttattagtatggtggcactattcaaacaaattaagtcaagggaatttggtttcaggaagaaggtgatgtggtaaaatttaagcatataattacaaattcgatatggtgataaaataagttattactatatattacatatgtaacattaatatacatatacaacaggttacatatgtgatatatattacattagatatgtatatatgtacatgatatataattccattatacacgtatatatatatatatatacacacatatatacatgttatatgtatgtgtgtgtatatatatacatatatatatggaagctaaaaatgccaataacacacattctctttcaaagtctccaaaacagacacagttctgctaacaccttaattttagcccacagagattaattctgaacttctgacctccagaacagtaatgtaataaatttgtgttgtttgaagccattaaatttctgctaatttcttaggagtatcataggacattaatacacctacatttctactgcacatatacatatatggagttatacataatgggatgaatatataatgcaattttatgaacatatcaccatattttatatataatagcacatatagacagcatagttgactcctactttttataagtagcaaaacagcagaaatgaaaggtaatataggaaataatcatatacatactatacattatatatataaaatgattacaatatacctctgtataatgtatatatacataacttttttctagtcataagctaaatgattacccgtatcttaaaagacaaccagactaaatggatgattggttttgaaaattattaaactaaaaacatgtttaattcctattggtaatggtgaaaatagaaaattcattctaaaaacactgagaaaactcctattcttttcctagaaggaataagcaaatcgccatcctttgtaaaagactcatgtcttttcatcttctcactaactttgaaagatgctgaaggtcaaatgcttatgtacctttacagtttacagtgtatcgttagggaaaaaacaagtaaataaaaatgagggtagaaagtaaaatcttgaattacctgaatttttcggagtttattcatttgctcctctagcttttgacaatgctcaaccagctgggaggagagcttcttccagcgtccctcaatttcttcaaattctgattgatatttccggctaatttcagagggcgctttcttcgacatctctttcacagtggtgctgagatagtataggccactttgttgctcttgcagagaactttgtaaagcctaaaaaacaattttttaaatacatttaccctaattgatgaataataattgatgagttttagtgaaattaactgtacttgaaatctatatgattcaaacatgtaaacaaagtagatgatcttctatcagttataaacttctagtggtaatttaaattttacatattatcctaagagtaacttgaatattatttagtggtatttaacactccatatgtatttttctgaacaatgtcaaatatatctcaaaactatatcttacagagccaaaaagttttggtgcatctaattttactgaattaagtatatatattaataactgcatttgtgatacagttaatggagttgaaattaattatactgagctttcaggaaagtaaactctacataaaactatagctaataatattgatatatggaatagaaaaacttattgaacaatctatgtacttaatatattttcaaaaaatgttattctgttatgtagtattatggtgggattcaaggatagttttgtggagaatttataaaatttatttatacttattctgtataacacatgtaatttcttacagtaggatcataactttagacttcccctgttcaatatttactttaatgttacttttactttataaaataataaaggctcatgacaaaaatggaaaaaaaaaccagaactactagtactttatataaattttcaatttgttctatgtatagctaaatattaaatatatgatcatgtatgcacatataaacagttattctttcccctataatgtgacctatatcaacccaaaatttgtcaaatatctaagttttatagtttcatagtatcctatgcctatttggtggtacttaatttgtttttttactttacttttttaagtttatttcactttttcaaattgttcccctatgactgattatttagacaatatctagcatataactacactttgagctaggtgttttagtgtgagcatttgcccatgtcaaataattattttttcaaaaacaaaaattgtaatggcttttctagttcaacaatttccattattagttctacacattcatttctagttttccactcctgtaaattatgtttatctctatctacctacctatctaatccatccatccatccctcaatcaatcaatatcctatctatctccagttccatttacatctttgagtgtattctgattatttccatcagatacagatttcatggaaattatattaatgttgtatgttattaggatgcactgaagagttaacctcagtaaaattcatattgaatttacatttccagcagtaagagacaatttttatttcaccacttgcaaattggtacttatatcttttgtgtgtatgcaatttagtatgcaaaaaaaattctcatcttgtaatttttttacttcttcctttacaatttaagttacaattattcataggtttattattcatatatgtctctttttggaggataccttactcaagactttcttccttactcacagaaaaaaaaagattccttggtatcatatttctttaaaattgtctctggtgtttttacaatgtttgtgattgtttccatcgatttttatgcttctccacctaaatttttataacattattattttaaatattttccaaaatttgggcttccccacattttttgaacattttattgtatgtggtttttattttggtgtaactttgggggaaatgttcatatctttttttttagttagttaatacatttcccaataatatttatgaacaattattttctttcctatctttttcagtggaaatagtctcttctgctcatctaactgccttttcttgtgttttctccactcttattcttgcacatttttattcttatgtttaaaagtttactagttctattaggcaacacatttttccagatagactttggaatcattatgccaagcattaaaaaccacaacaaaaggaaacaaaaaaggtgaaacagctaccatttggtattgtagtagaataaatatctaaataggacaatacataatgaaagttgtttaaatgtatttttctttgaatacattacttcaaaaaaatatttaattatccaaaaaaaattctatgtgataaagtttaaatttgaatttttaaacatttttcttaaaatgcacatattatctcagcttctaaatataactaatacgttttcatgtcttcagaaataaaaagttattgaacatataatgtagtattttataataagtaggaaaagggctgggcgcagtggctcacacctgtaatcccagcactttgggaggctgaggcaggcagatcatctgaggtcaggagtttgagaccagcatggccaagatggtgaaaccccatctttactttaaaaatacaaaaattagccaggcgtgatggcacgcactataatcccagctactcaggaggctaaggcaggagaatcacttgaacccgggaggcgtaggttgcagtgagccgagatagcactgctgcactccagcctgggcaacaagaatgaaactccgtctaaaaataaaataaagtaggaaaagtattataaaatctcttacaaattatttctttcatttcccatattagtatatctttcctgatagaaggatgttaaaaaaatgtagctattagaattcaaatgtctcattacattacagaaaattaatgtttaaatttaaaccaattttataaatatagccagccctccatatttgtggattctgaatgagtggattcagtcaactactaatagataatatttgacaaaaataactacatctgtactaaacatgtaagactttttcattgtcactacttcctaaataatacagtataacacatattttcataatatttacattgtattaggcattataagtaatccagagatgagttaaagtatatgggagcatgttcataagttatatgcaaatattacaccattcatataaaggacttgaacatctgtgaattctgatattcataggagttcctggaaccacttccccatggatacgaagggatgactgtacactgattttacccaccagtttgagaatgtgacaggagttacaaataaagaagcaaaggtggggaataaaacaatggtttttctaataatcaaaatcaatacatctgaaaatgcatgctaaattaaaaatatacttcataaatagatcatacaattgttttcaaaaacagcatgtatatatgcccatacatatatatccatagatagagtatatgcataaataatactgtaaagtctcattttcatttgctcaatgggcaaactaccatacttgtcagaatgacttaaattctaatattatttaaaggttatatcaatgtgaatgcttgataagcgtgctttattgttttgacattcaaatattcacagacctgcaattccccgagtctctgctccatgatttcatagtcggtgacactaagttgaggtatggagagtttggtttctgactgctggacccatgtcctgatggcactcatggtctcctgatagcgcattggtggcaaagtgtcaaaaactttatcaaaagggaaaaaagaatgagaatcacttaattgtttcacactttgccatgttttcctaaattgtcagcaaactcaattatattactagtttcaaatattaacaaaattagaaaatctgaaaaatatatttaatatgattatgaagatacattcctgctacatgtgtaatatgccagggaccttacacatattacattaaattcacaaatcagcctgtaaaatctatattgttcaattcgttttataaggtcaggaaacagaaaaacagataagggcaggaaacagaaaaacagagaagctaagtaaattgcccaaggtgatacagatggtatttgcagaaaccgagcagggtccaattgtatctgatactgaaaggctactctctctcagtgttatcatttgccttggaaaaaaaatagtatcattatccgaagaccttgatttttaaattatatcatgtcatgtctaattttactgaaagaacacccatgtacgcatgcttagtatatgtatcaagaactctagtaataaccccataaatattatcattcttaattcttataataaacctgtgagacatatacattgttaatcccaattgcaattgagaaaacaggctattaaagaggcatatgtgtatgtatatacttttatatgtataattatattagggaaagtattatatagagatatacagtatgtatatacaaacaagtttatacgttttaaagtatgtatgtgtatatgtatatatatgaaatgtgacttaagcagccacatggactatattgaaagagattagacacaagattgagaacgctgcagagaactgtaaaccataaaaaggacataacatattttagggataatccaaaagaaattctagaattaaaaatacagtaagtgaaaaataagaattaagtgcatgggtttaacagcaaatttgacaggggtaaatagaaaattactaaatcttaagattcagaaggaaatacctggaatgaagcatggagacacaaaaagatagagaacacagtaaaacggtctaatatatatgcatcccagaatgtggcagaagccatatttaaacagataatggctaataatgtttctaaatacatgaaatcacactgcaaagtcctggtttatatcaccacatcaaataacattatctaaatcatattattttaattgctgggatatgaatgtcatttcaatataccaattccttctacactaaatgagaagaatataggaaagtattttgcatgtatttaatgtagtattcagatggttgcgataatcttagagagtgtgttggcaatggatgctgaaatgttagaaatggataatttttttcaatatgtttatattgcatttatttgggaactcataaaaatgttaagagattatatttaatctgagcacttctgatttcttattaaaagatatttgtagtacttaaaatctgttttaatttacataaataatatgtttctctattaacctgatgcatttattttttatttttccataagttattgggggtaaaggtggtatttggttacatgagtaagttctttagtggtgatttgtgagattttggtgcacccatcacctaagcagtatacactgtaccctatttgtagtcttttctctctccccccaaccttccccacaagttcccaaagtccattatatcattctaatgcctgtgtgtcctcatagattatctcccacatatcagtgagaacatacaatgtttggttttccattcctgagttacttcacttagaataatagtctccaatctcattcaggtcactgcaaatgctgttaattcattcatttttatgactgagtagtattccatcatatatacatacatacatacacacacacacacacacacacacacactcaccacagtttctttaaccactcattcagtgatgggcatttggattggttccacgattgtgctggtgtgaactgtgctgctataaacatgcatgtgcaagtatcttttttgaataatgactttttttcctctgggtagatacccagtaatgggattgctggatcgagtggtagttctacttttagttaaggaatctccacactcttttccatagtggctgtacttgtttaaatccccatcagcagtgtagaagtgttacctgatcaccacatccacgcaaacatgtactttttaaaatttttttgattatggtcattcttgcaagagtaaggtggtatcacatggtggttttgatttgcatttccctgatcattcataatgttagcattttttcataagtttgttgaccatttgtatatctccttttgagaactgtctattcatgtccttagcccactttttgatgggattgtatttttcttactgatttgagtttgttgtagattctggatattagtcctttgtcagatgtatagattgtgaagattttatcccactccatgggttgcctgtttgctgtgctgattgttccttttgctgtgcaaaagctttttaatttaaattaggtaccagctatttatctttgtttttattacatttgcttttgggttcctggtcatgaaatccttgcctaagccaatgtctagaaagttttttccaatgttatcttctagaatttttatagtttcaggtcttaggtttaagtctttaaaccatctttagttggtttttgtataatgtgagagatgaggagccaatttcagtctcccacatgtggctagccaattatcccagcaccatttgatgaaaagggtgtcctttctttactgtatgtttttgtttgctttgttgaagatcagtttgtgtaagtattttggtttatttctgggttctctattctgttctgttggtctatgtgcctatatttataccagtaccatgctgttttggtgactatggccttatagtatagtttgaaatcaggtagtgtgatgcctccagatttgttctttttgcttagtcttgctttggctgtgcaggctcctttttggttccatattaattttagaattttttttctaattctgtgaagaatgatgctgttattttgatggggattgcactgaatttgtagattgcctttggcagtatggtcattttcacaatactgattgtacccatccacgactatgggatgtgttttcatttgtttgtgtcatctatgatttctttcagcagtgtttggtagttttccttggagaggtctttcgactccttggttaggtatattcctaagttttttgttgttgttgttgttattttattttattttttgcagctattgtaaaaggggttgagttcttaatttgattctctgcttggtcgttgttggtatacagaagagctactgatttttgtacattaatcttgtatctggaaatgttgctgaattattttatcagttctagaaactttctggaggaatccttagggttttgaaggtaaatgatcatatagtcggcaaacactgacagtttgacttcctctttaccgatttggatgccctttatttctttctcttgtctgactgctctggctaggacttctagtactatgctgaagaggagtggcaagagtggcatatgcatttatttgaattctagatgattattaataaacaaaatccaaaagggaccttataaatagcagtgaagtaaagaggtatttagttacaatgaagcaaatgattgtgtctgagatgtcatttcagcaaatgatctagaaggagaggggactatgggcagacacatggcggtatgttggatgaatcataagcttcataaaatttggtttaattgaacttgaacatgtctcctctttaacttctttctggtctttctgtttaatgaaaactgaaacacttcagtctctgaattattgatctttttctgtataacttctgatctgtccaacaactgaatctcacaggaatcacttcatattggtaaactataattaaaacatgcatattttaattcctccttgcattccaaccctcatcctagttttgtattaaattcatttgaaactggtcatttcaaaaaatctaatctcttggaaattcttttgtagctttaagaaataaacttccaaagattggtttgggaacttgtccatctaatatagtttgtgaggcaagctggaaaaaaaaatacacacctactaacataaatatcacaatttctttttctgattttcttatgtggaatgtaatgacactatgtaatgacagcagtaattgctatcaaggttcaggaaatgcttgacaaatttgcaacggtatagagtatctcatttaaaccatgcaggccagggaatgccagtgaagaattctaaatctgtttcagataagaagaaagaaaaagtcttatacagaagctaatgtacccaagggcaaacacagtatgagctgccccacctactagctggtgagatatctgtagatgctgcccttgtgatcccaacataggagcagaaatagaccagctccatctacggaaactcactttttttccttttatgtagaaatagagattaataatccaacagataagtttatctttactgacagcaataagacaataaacatatccaatctaataacctaccatcttaaaagacctcgagagttctactgacatcattagactcagcacagactcaggaaaaatatggcctgaagatttaacgtttagccaatatattgcttataaatatgtaacttttttctctaaagaaagtattcctatgacagtttctactattcggctgctaaaggaccactttaaaaatgcagatatctttttggttttattagtgaaatatattcaacaaaatgaaaatcaatataagtgattgcaagcttggaagcacgtgctgtaaattattgggaaaataaaaattaagggctcctatcctgcactactgtttatcttgaaaagtaaaaaaaaaaattccattaatatctagacatttaatatagccatgtgagggatggaagtgataaagtataggcaaactgacatctaaaattatagtaaaggaatacaaaaaagaagttttctgcaccttttgtttaaaaactgcttgtctttaactcttaaaagagggaggggctaaagggaaaagaagagagaaaaaaggagagcaaaggacagaccaagagaggcaaagcaagattcttttgtgataacaaaagagctaagtatgaaattagatgctacattttctaatacacatgagtctatgtcaagggcaaaccactttaactggaaagcaaagtaaacagagaagtatattgaaaattctgagagacataactatcgagataaagagataccagagcaatcggttatatataacactttactgaaaaaaaaaatctctcctcttgaaaaatagaactactcagaaaataggcacttaagcatcagagaatgtacaatagagagaaggaagacgtaactgtgccaaccaataaggtagcaactggctacccgtccgttaagcacttgaaacgtggccagtttgagttgagatgttttgtatatataaagacacaccagatattggacagttcatacaaaaagaatgtaaagctatttccacattttaaaattttaattctaagatgaaacaatattttcaaatgacttttacctgttgatctgttaatgtggtttctagaacatttaaaattaaatatatggctcacattatttttctgttggatagtgcttagatagaagctggaaaaggcacccatgtaatccatttagggggagaaagagatgatatgttagtagtcttaatattgacagcatttaaaaacattagaagtcctgttgtgaatatgaaatcgagtccaatttgaattccccattattacctgtggggaaaaaaatgcactgcacatgtgtgaagaagctgaactaatgacatatacctacttcggcaaaatgctcaacttgagcctttaattccatgccaaccagatcccacctttttcctcattccccatgatcaatctaaagtcaaggagataatgcaatcagcaaaggctccaaactttattaaataacatagaccatgacaaaagtaagcatttctctaaaatgtgaacactgacaaaggtgtcaagaaatacaacaggacccatgcatgatatatgatgattaacatactaggaatggtccttcagataattacaagtgcaaggaagtctgagtataacttgaatttctaatgtcaatatataagttgtttccttagtttgaaatacaaggatctttgtgattgggaattcaatcaacattttagcccaatttcctatcaaaatcaatattctatcctccagtcaaaatatgccttttaattacttcacgcctttttgcttatgcaacttgctctgctgaaagtcgctgctgctcaggctccattctcacaaagggcacttggtgtggtctgacatgagtgaaatagatgggtttataggaattttatctaagatcaccatagaatttgttttataagtcataaaactccaatgaaccaactgaaattggggtcattttcataaatactgctctattattcacctcctggacaactgatttattttccaggtaagtctcatttttctgaccaactttgtgtaagtataaactaccacactacagaaatatttattagaatttaagagtttttttcttttgctgaattttccctttttctaaaagcagctctatccacttagcaatcctattttcaaaatatcatgttaaactatttcatatttaactaacaaataataattatgtgtatttatggggtatcatgtgatgttttgatctatgtatgcattgtaaaatattcactcaggttaattaacatattaatcacctcaccaacttatctttttttgtgatgcggatattaaaatctattcttttaccaattttgaaacatagatttttattaactgtgtccaccacgcagtactagagatcgctacaatttattcctccagtctaactgaaactttctatcatttgatcaacaccttccctttcccaaccttcctcttccccccagtctctggtaactacctttctattttctgtttctataatttgacttttttttggatttctcatataagtgagatcatacagtatttgtctttctttgcctggctcatttcagctagcctaatgtccgccagttctatctacatggtggcaaatgacagaaattccttccttttaaagactgtatagtattccattgcatatatatatcatatatagacactggaatatatttatcactatatatatatgtcactatatatatcagtatatatatctctatatatcagtatatataaatcactatatatatctaccactatgcatatatcactatatatatcacattttctttatccattcgtcctgtaatagacatttaggttgtttccgtatcttggctgttatgaataatgctcaaatggatatggcatgggcaacaaaagcaaaaatagacaaattagattgcatcaaactaaaaagctcctgcacaggaaaggaaactattaacagagtgaagaggcagctcacagatcaagagaaaatatttgcaaaccaaatatctggtaaggagttaatatccaaaatatatagaaacctcaaaaaactcaacagcaagaaaacaaataacctgatttaaaaatgggcaagggatatgaacagacatttctcgcaataagaggcaccaatggccaacagatatgtgaaaaaatgctcaacatctctaaacatcagaaaaatgtgaaaaccacaatgatgtgtcaccttacacatgttaaaattagaacggctactttcaaaatgatgaaagataaatgttggagaggctgtggagaaaagtacacttacacattgttggtgggaatgtaaattagtacagccattttggaaaatagtatgaggttcctgtcacataaattttataaatgtgtgtgtgtgtgtgtgtgtgtgtgtatatgtctacatgtgtatatacacagtatgtgtctatgtgtgtacatacacagtatgtgtctacgtgtgtacatacacagtatgtgtctacgtgtttatatacacagaatgtgtctacgtgtgtatatacacagtatgtgtctacgtgtgtatatacacaatatttgcctacgtgagtatttacacagtatgtgtctgtgtgtgtacatacacagtatgtgtatatatgtacatacgtatatgcacacacaacttgtgtacatatacgtatatgtacacacagcgtgtgtatatatatatgtatagctttaacttggcatttagcgagttttcccatgattcttgaggtcagggaacaattcttttatctcacaataagcacatagcttgcttaaataaacatgtctgctatgcttgctcttgatggtattgataaaaataacacaatttttaaaaggaacatttacaaacagtttacctagtttctggagtgaaggagcaatgcaacagattatgtgtctactggaacaaaacattcctttgcctagatgtattaaaaataaaattttaaaataaaaaatttaaaattttaataaagtaaattaggtcaatttcctgaactgcagctagaagagttacctcacatcaaactttgttttaattcccagtctcagcatcctaacagggaggggtagagactaaccatagagcttgaaattgtggccatggagagcatccttgctggctacccttaaaattttcttctactgtctctgtaagaggtaaaagttattttctttcaattctggcaagaatatcttctgtgctacacctccccagatcatcacctcttcaagggttgaaatgatttttctttatcttatcacaactgtagtttaaggttcaatggactctcctctgtgtggctattctttccacaagtcttcctgcttctcctcagacttgtattgcatttcttcttcacataccagctagagggtgagttttgaaaaaatacaactaagggtacttaatttcctcaattgaaattctttcggaaatgtctactgctcttaaaatccaaacctgttatagaagttctataagagcaattctaccctcatcttgtcctaatctttcattgatttgttacattccagcctttctggcctcccttatgtcttctggacatgccaagccctcattcttcacctttggcaatttgtgtttcttttcatttctcctaatgtcctttctccaacttatcatatagctggcacctgcacattctccaggtttggttctaacatcatctccccagaatcacggtttcagacgccaaagtaattataatctgcaataatattcagatattcaattttattatctttctttcaataagctccatgaagacatattgctcttgattttctccaccatgtatattacctagtgcccagcacttttacggcatataccaggtgttcaaaaatatttcttgaatttattagtgaaaaagtgagcaagactctgttctgaaagcaatctaatggtgtagaacagaagagaatcattttgaaactttagaacagtcaaaacactggctttgtcataactaataatgtcactttctccatttttgcaaaactaaaccaaaccaataaaatccctaataattattttaacatgatttccaaattgttaatgaaataaactcaaattatatgaccaatctttttccttctttacattaagaaataaggtttcatttttttctttgttgaaacaattatctacaacagactagatgctgtgtttctatattcatctagcatataacatgagtttactggttttcagtctctagaaaagtattttatcaactgtcatgggaaacaattccaccccctcatcctcccagacctaggcaaccactaatcttatttctgcctgtacagatttgcctattgtggccattttatatcaagagactcatataacatatgatcttttgtgactggcttctttcactcagcataatgtcttcaagggtactccatgctgtagcatgtatcagtactttctccctttttattgctcagtaacactgccttgtatggatgtgcccattttcttcatatagtcatcactggatggacatgtgggtttcttctacgttttggctattatgaataatgttgttatggacattcgtgtatacgatctagttcttacagcatcccatatccatgcttttagttattcaaaccccattagcttacttgtgatatagttgtaataacaaatactcaatgtgtttctctctgagggttaggtaaaatgatgtataaattagttatgcatagagtaaaaagtgctttgaaaatagaattttatctttttatattattttcttctatcacttatgtcaggtaacaactaccaattccttatgccattttccaacactgatagtatattttaaaagccaggtttttgtgtgaaaaagcaagtttaaaaaagtaaagaggaaataaaagtcagtatggatgcctaggcacttctgttagctcttatttcctgcatacttaatacgtccaaagtactgtggaggaatacaagaaatgagatttactccctggtgccagttcggatataatgcatacacatgtgcaattatttgaattaatttcaaattaacaaaatcaactgctatgtaatttcatatgctacatttttcattccatatatatatatatatatacaccatatttaattaaagggttatttattaatctagacaagcattccaaaagggtgaatagtaaaattaaagatgtgtagctacagtggaagtggggacaatttgtttacatataatagcagtgaaaaagttaggaagttttataaacaatcatcgtttgtaggtatgaaatttaaaaaagagaagaaagatgatagggatggatggatggatggagagctgtatgaatagagactatatattattacgtatttatattgtaacatcatagacaaatctcagttatcaaacattgctattctgaacatctttaaagtaaatgataaaaagttgaactttaatatgattaagaggtatatacagattaaagtaaatttccagtgaaatggctcctttgcacaacaattgctgcatagccactaaatgtatttaactttaagggggagttatgtatgtaatgacaagtgaaaatacattattgttaaatatgtcaatatttgaaaatctaggacatttaaaatattttcccaaattgattttgcagaggcacagtaacaagtatactgaaatccactagagggagctgatactatttataaagttttactacctgtacaggaaaataaaccccttagcaaaaacgactctgaagtacaaaaaaaaaaaaaaaaaaaaaaagtatttatcctttgctttatttagctcatttcatttttgtaaaaaatgaaaagctgggaaatgagaaaagcgttgtgtatcactacattaattctggaaatgatattatatggtgaattctttaaatatttacaaagaaaagcaataggataatatattttccaactaatttaagttttagtagtaaacaaacacatgttcctgtgcttctcatgacaaatttgggacagagattttttcagaaaaatacttttatcttaatgccttcaaacccgattttactcaataattccttttgtgtgcacatgaacacatatatgcatgtatatagtgaatcaaaaccccatttactatttcttaaaggtggtcattcatctgtctctgaaaagaatttttgtcttaaaactaagttgatgagtagagatattttggagcagatactatgtattaacatcatcttattaaagcaattcaggaagagacaaaagaaacatcttgaaaaatttgctagtcgcatggcatgaatttgcataattgctccacttttatcttttatcatcaaaggaaaaaataggatttatgtaattatagtgatccagtagtaaaatgtagcccaaagaataatttgtcctttgctgagtttcagttgccacatgtatgctaaagctataatactcttcagataaattgacagaaatattagaagatgcctagcaaatatccttgtatatacagcgagccagacttaattgaagtgtattcatatgacctcaactgctcttttattttcttctatattcaaaacatctgattttgaaatctacaatcccccaaggagaagctattcccatacaaaacatgttttgtttctcaaagtcacaaaattattatgaggacaaaaaaatctacagacagcttatctgttacaccagtatttcgttccttgttaatacaggttgtagggagaatggttccatttacagaaattattgtttcatgttagtaccttctggatttccccacaaataaccattttggaaaatgtcaagttagccattttaggctttttacttacttgtctgtagctctttctctctggcctgcacatcagaaaagacttgcttaaaatgatttgtaaaggccacaaagtctgcatccaggaacatgggtccttgtcctttctctttcagggctatgctttgaatttttaatcgttcaatttgaggttgaagatctgatagccggttgacttcatcctgtgccatagagtatggaaagtaagtaacacgtttactttgcatacattacattttgcaaaagaaggtattaaaaagcagtaaggcaagtttagcttaatacccttcacaaatatctgataagaaacatccatgacagtatagacaagcctctatcaccagccatacatttaaggataccttggctctttgttcaatatgtatcatcctatataatgatatttaaatttcaagatgacataatttagagcattaatgggtatgaatgcgtacagtggaaaaatactatgcatgaccttaaatcctttccataaatcaaatataggtgtttggctgcacccctcttatatcaaaatgatgtgcgcttgcttcaaattttaagctcactcaatgaacaatattttctctttcatttctgcaaaatataaattacatatatacctacatatatgtatatgtgtatactataattataaatatattttgatacaattatatagattatatacacacatataaaatctatataatacttatacatatgtatgtacacacccaaatataaaaatatatctataatcttctatgttttgtatggtctcattacttctcctgaccaaacaggcaaccactgcttttttttttttttttttttttttttgggacagagtctcgctcttgttgcccaggctggagtgcaatgacgcgatcttggccaaatgcaaccttcacattccaggttcaagcgattcttctgcctcagcctcctgagtagctgggattacaggtgcccgctaccgtgtccagcaaattttttttatttttagtagagatggagtttcactgttggccaggctggtctcaaactgctgacctcatgatccacccaccttggcctcccaaagtgctgggattacaggtgtgagccaccgcgcccagccaattgccactttttaaattacggtggctgtccaggtttcctcttgttgtcctggcataattattagtagcaccctgtttcactctcagtagtaccctggtttgtatgataaaatcacatgaacactgctgtactgtcactagctcatgtggcaactgggcacctgaaatgtggctggtccaaatttagatgcatgaaattaccaaaatatgtttaattctgaagattaagaaaagctaagaacataatctcaaagtttttaaatactgattacactttcaaataatatttttgatgaatcaggttaaataaaatgtactattgaaattcaattaccgtttctttttcctttcctaatatagtttctagaccattttaaattacatatgtggcttgaatttgtggctagcactgtatttcttttggacaatgactttcttcacagaattggaaaaaactactttaaagttcatatggaaccaaaaaagagcccgcatcgccaagtcaatcctaagccaacaggacaaagctggaggcatcacactacctgacttcaaactatactacaaggctacagtaaccaaaacagcatggtactggtaccaaaacagagatatagatcaatggaacagaacagagccctcagaaataacgccgcatacctacaactatctgatctttgacaaacctgacaaaaacaagcaatggggaaaggattccctatttaataaatggtgctgggaaaactggctagccatatgtagaaagctgaaactggatcccttccttacaacttatacaaaaatcaattcaagatggattaaagatttaaacgttagacctaaaaccataaaaaccctagaagaaaacctaggcaataccattcagggcataggcatgggcaaggacttcatgtccaaaacaccaaaagcaatggcaacaaaagacaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaacgaactcaaaaaaatttacaagaaaaaaacaaacaaccccatcaaaaagtgggcgaagggcatgctattctctacataaatgttttcatgttcttgtttccagtgaagttggaattgtttcgtatttaatacatatataatttgaactcaaagttttcactgccctttttaaaagtgttattatcatggctgcttacttacaattcatatatatgctgtctttagaaaaaaatacttgagggttagttactatttaatatgtaacaacaggaaaattgaaatttaaaaattggaacatgagcccattagaagaaagagaaaatggaaagaattataccaattctgaacgaattgaaatctgagcttcctgaaaatcaaagtgaaaaggcaaaaaaaaagttaatatttatggaggcattcatactctttgggagagagtaacttttgtattaggagaggctgagaaatttatcacataaattctgtcatggttgcaagactaatgtacaatgccacttattctcattaaaaaaacataaatacagctttcagaggaatgtgtttatgtggttataatggtatgagctgattcaggtaaaataatctctgacgattcaatcgttttggtgggtgaagattaaagacgtttagcaaaatggaaggtgacctatatttctctttcaaatataaatcctctcaaaccagtgctagaaagttggtatatatccatggataagaaataagacaagaggtaaagggtaatattctgtatttatagtacagaaatatatacaaataatttgtatgctagatttacaaatggcagcattggcatctactgtgaaccattaagaacctgatttatatttggccagatggagggctgccatttttcccgttcagggggctatagaaagagccaacattatagccaagtgtgctctgaaaaacaaaggggactttgaaactaataaaacatttgggcaaatgttcagttgagaccttaatgttctgagaataaatcatagaagagatacttttcaactgaagtattctgtgtttaaaaagatgtgaacaattagccattatttccataaaaggatttggtttagttggtcctccagagtatggtatctcctttgagtctgtttattctttaaaattatatgcttatctcatggaagcttttgtatttttcacaggaaagggttcatgaattttttccaattctgataaggctctctaacccccacaatattaaaaaccagttctgccgatcattagaatatgagctaaatatgcgctctaatgttataaaacttctccaaataaaataaaacgctgagaaacatgttataatttatttacctatcactaatctcagcagaacagtatatatatttgcccttgtatgaataatattaagcttatcttgctaaatattttacctaaagtgattcttcaaattaatagacaccaatgggtctgagagaaagagtaaggggtgataaggaggtgacaacggaatttggatgcagtaagagaagtattttcccttaggatgacttcctcaacctccagacaatatttaatatataaaacctctggtgatctccatttgttcctcaaatcaagaccaagatactagcaggtcccagaagtcattggtttgtctcctatatacctgactgattcctgtttgtctctcctctcattcatctgcccctctatgttcagcatttacaatggtcttcattcaggtgcttggcctttattgctccctcttgccatgttccttctgcctggaatcttgcttaactgttctcttacctaattctaacttatcacaaaagtctcaactcaaatgttcctccctcaaggaagatgcccttggtggctgtatcaggttcgtttttccctgttactcattctcccaaagctttgcatcttagtttaaaccactgttcctagcaggaaatttaaaaatattgattccattgtttcatatctctcttctctgctttccgtaaatacaataaaagcagagtccatgaatgcccactctaatattcccaaaacttagtgctatgggctgaattgtgtcttccaaaattcacatgttgaagtcctaaccattggtgagactatttggtgataggacttttaagaggtaatgatgtttatatgacgtcatcagggttgggtaagggtggcggggtggggggctaatcccttagggattggtggctttataaaaggaggcagagataaagagagagagaaagaaaaatagccctcattctctctctctgcatgtatacacacagaggaaagccatgtgaggacagagtgagaagttggttatctgcaagccaggaagacagccttcaccagaagatgaagctgaaccctaccaaaccttgatcctggactttctctcacttctagaactctcagaaaataaacctgtgttgtttaagccaccgagtctgtggtatttattgtggcagactcagctgattaatacactcagtagcattcttaaacacattagagacacttaatgtatatattttatgcatgaatgtactgtgtaggtactattactaactactatatctgaatctcaagaatcggataaggtaacatcagatttttgtggcaagaaataatgtatttggattattcctctgattcacaggaaaagcggcattggttctattcttaaattacaaaatgcatctcaatgtagaaattccttagatgtgtgtatttgcctaacaagtcaagtgccttatccaaggtattctttatccaaaagtatactttctgagtttatttcctcagcaaactaacacaagaacagaaaacctaataatgctacaggtccgatatttgaagaaccattaagtccttcaattgtttttctcttcaaaatagctttgaatttctcatcactttttgggtccaataccttttctaaatcaaccttgtcacctttccatgtctattctacctttatttaagccattcttttttacagtatgcaaatgaatctccactccttgccttttgtattaaatgtaatcatctcgatctatcactaaacgttcatcctggaaacgttttagtccatcctctaatcagtttctcattccccgcgaaaagcacatagctcatagtaacaatgaaaacagtttaggctattttcattattatacagctcttgttttcttacacttgaaggcataatcctttcatctctttctcaggcccttttgtccacttacatcttgtttgcccctccagatccactgtccgctcttctcctgttacccaggagactgatatttacagatgacggttccttgtcctttgtcttacgattaagtttagtcagtgaggagccctgacaagattctggaggcagggaaaaaagtgaagtggggtgtttatttgtctgactccatttctatgaggattccttaagccggccatgctgcttttaccatgaggatctgactgtctccttctgagtttctataactgctctctcactgatcctttctggactaaaaggggtaagaactctgatgctgggttactacactatccggtgtggttcctctgtactccagctacattttaaaaatatctttttgtaaagaaaccttcctcaaattatcgtaatttgagaggtccatcagttttaaatattttccttatgtatctagttatactgcatccaagcttgttgttgacccgtgtttctaactatttccatggattccactttttcaaaatgactatgtttcactcgtcacaaagaaagagttccaaagtgagaggccattttttacaggatacatgtggtttccacactcctaaactgcctcatgcttacgcaaaccgacacaatcaattagcgctgtgtaactacgccaaatacaattttagaatccgggtatctacgtcttacatatttaaacagatttctgttgcttacattttgaactttattgcgcttagctaaatccttagaaggtgaacgtttcattactaaataatttgttactgtcttcttggaaattgccaagaaatacctattgattatgctccaaatggaaggagaagagattcttaccttacaaatttttaactgacttttaattgctgttggctctgatggggtggtgggttggattttcaaccagttttcagcagtagttgtcatctgctccaattgttgtagctgattatagaaagcgatgatgttgttctgatactccagccagttaagtctctcacttagcaactggcagaattcgatccaccggctgttcagttgttctgaggcttgtttgatgctatctgcattaacaccctctagaaagaaaaaaataattaaatatatcccctgaacccacagactgaaagaaatgatctgaaagccaacacatcctaattataaaagtattcaccacatgaatgatttcaaaccagatcaattattttctaagatataaatgtgtaaatatgatttcagattattcaatgtgaattatcagacttgcgtcacaacaatgaatatcaatgccatcaagtaataagacataagatgtagaaaattagaatatatgtaaataaaatattaaataaaaacttaaataaaaacaaaagtgctcaaagctctgatgggagctggaaggctgcatgaacaagtaacattttggatgttttcagatacattttacatatcatacatattactcaaatatacttccccaaactaacttacatttttaattttaaaaatgggcttggaaattagtttaaatagtattttcatagttttaaaaagaggaaaaaaaatccaagattattctttatttcatttacagaagattagaaataaacagattgtcggctgggcacggtggctcatgcctataattccaacactttgggaggccgaggtgggggatcacggcatcgggagatcaagaccatcctggctaacacggtgaaaccccgtctctactaaaaatacaaaaaattagccgggcgtggtggcgggcgcctggggttccagctactcgggaggctgaggcaggagaatggcgtgaacccgggaggcggagcttgcagtgagcggagatcgcgccactgcactccagcctgggtgacagagcgagactctgtctcatattgtccatggatgcgaggaagaaaaacaagtactaggaaaaataatctttctaatgtgaaacatttttaaatttataaatgtagaagttgatctcaaagttttaaaatcatctgtagtaataccaaacccagaaaactttatcaagggaaaaatggaaacacaagcatatcattatcaccattaccattctggagtacctactatgtaccatggaatatgctatgtcatttcatatatgacgaacgccagtccaagtacatattattccatacatagcatgaaagcatggcaacatcacgctgtgctatgggttaaaatattcaaactctctaaagttagtttacaaaatttagactttcttagatttattagcttatatagttttcttaatgacagaatataaaagagaaaatatattacatatgatatcatgcatttttaaacatagctacattagcactgataactttcttatactttggaaatactgaatatttaaatgttttatgttccctcatgtacctacagagatctcaaaagaacataaactcactgtaaggttctttctctaggttaaaatacctaaaagttcgaagagtagtttggtagaagagtaggttgcctaagataatctacttttataaatgttcattttacttaattttctggtaatataatttagttaaagggaagctaagttcttaaaaagtctgaagaacgtctctagaaacataaggcctgtggttttgctaacttgcacatgcctcccactttatcctttttaaagactaaaaaaaatatagatgtgaattcaacaactatattattttatcctctttcacttccctctgccctgatagtctaatgttctatttgtcataatgatattaatgctgccaaaccatgtccctcaattcatttgaaacacaactgtaacttcactaatttcaaagcataatgctactcaggatggcggtgaaggagacaaactttgcaaatattatcgtcaactattttcccctccttcttccctgatatatttttaatgagatacaatggaaataatagaatgtaaaaagaatatatacatggctccatatatctaagtataaaagaagtccgtggcctacaggagctacatattctaatatcctcctaatgcttaaggaagcaattgtgacatgctgtttttgatcgttagattttgaggagtgatcaaaaattgtaccaaaatatttgttaagcgatgcgattaagtaactgttgttataaaatgaccacatttggtataaagtgtaagagaagaatatgaaacttcaatcgtatgagcactccgtttgaaaaaagtattatgataaaacgttaacatttctggaaaataaaaagataattagaaaatatactggacagaatttttaaattatgttaataacaaaaaatgtggcatggatctaaatgatcagatatttaggagaaatattttcagcatatgttgaacttgaacaagcagttagaagtccatgaagggtgaaacgtcaacatgaaccaggtattaaacaggcaaaaaagaaatgctaaattaaagggaccgatagactgatgctggattgagtcttattcaacatttgtctaaatgagacgggaacacagagagaaatcactttgtgtccctgagaaaggtcaaccatacaaatcgtagcaaatgaaaaaatgaaactataagttgattttcaatatggatatgttaattttgttaaatgataaaactacagtgaagtaccaataggctctgcagtatccgttaaaatctagggacaggttttaatgagtcattgttgatcattacacaaaactctatgttttgccccccaaaaaatgttgcaatatatcactgtaaaagaaatttaaatggtgaagaaaagtcagctttgtacaaattcataacactgaaatttataatacgctctatttatttgcatattgatctttataactgaatgcaggcaatgaaaatgcagtgataggtaaaagaacgacatctataatagcaaaaagggggaggcaggcagaaaggcagagaaatgaccggtgagaattctggcgttaaagagaccggagttcaaatttgatgccccttactagatgtgtgaaatgggttcagttacttaatttcactggatcttgtttttctcatccatgaaatgaggattaaaaatagaatcgacctcataggatacttaccaaagttctgagttaacatatataacttacttataacaaatgctgacacatactaggcaacaaagacatattagacaatgccatatagaggaaatgaaaaagaatattcagaaaacaagggaccagctctcttgtgtgaaaattagggggagaggaagtcttcttaatgactgaaacaggacatgtataaaaagttaataatactattttaaaattagtcctaattttatataatatatgactaatatgggatatagaaggtgtatttatacattttttaaagaagttttatcaataaccagggatcctttgagaccaggagttcgaggctgcactgagctatgattgcatcactgtattctagcctgggcaacagagcaagagcctgtcaccaactaaaataaaaataaaaagagtttatttgggaatcctggaatattctgccacatttataatcatgtgagattgaagttataaagaaacgaaaacatttcaaaaaaaacgtggaaatttctagatgttactagaaaagacataatgttgggcacagaaaatcagaagtcttgctatgaaggatttgtatgcaaacattgtattaattcattgtgaatatgctgcctgctcaacaagggcataaactgtccttctaaactataaactcctataggaaatgtctccactggcagtatctaatagaattctcagcttggagtagaaagagtataactacactgtactcatgaactcattcaataccaaatcaatagtgtactctatatgaatataaaaattatgagaccaatgtacactgaagccaaaagccatacacaaacaagcacacaatctctcttgtatcaaatttgctttaaaatacttgggcaggggatggagaggatggtcacgttacttactgacactgtcacgttaataaccgacactgtcacattacttaatgtacctctcttcaattaaaatgagaaatgctattacttcaactttatgaattaattgaccatctaaatgccagaactactgttgattttctaagaaagtccattaaaacctttctagaatgaaaaagggttcaaagcgttatccaagtaaatatttgcatatggattttattattatatataattgttttatatgtattccatagaattatgctccttgactcaatggaaaattttaacttttctaagagtttgtaagtgtaaatatctgaaaagttttaagtatcaatcatctgagcatctgttttctaattttgtgttagctatttaagaatacaaatactaacacaccaggcattatgagcaatacttatggaaaccattttgttgtagcacattagaatctcagggataatggatcataatccattcacatctcatattctaaacaacccctgaaatagtctgtgaataaatatattgcacccagaggaaatggatcattacttgaagtgtatccattaattttattacttgtgtacagtgcataacagactgttagaataatgttaaatgtgcaccaccttccatgcaagtacttcagaactgccacttaaagtgaagtattcctcatcaagtatattcatcattagccatgaagccagggtagaataacacaaaacaagtgtttccagagctcttgaattaaaagaatatttggaatagaaacttaaaataaagctgctaataaacagtctcctatttttgctgaactttaagtgagggttattacaagtccatttagcattcaatgtaatagtctaaaatgtaatatagagatattcaaaacctgtgaagacaagttctgaggctaaattttagaggtttctgtgaccacactgacttaaagtaatagcttttaaaaattaatagtatatataaaagtaatacccctagtgagggcaatataaattttactaatatagcccttttgcgtttttattttcaaacatcataaaattaaaaaaagtcagatttttactcatatttgttttggccactcatttcccacaacaacagtgacaacaacagtctctttctttcacacacatggacacacacacgcacatgtctgcgcatgcgagttcacccgtgcatgcacgccgtgctcacacacacccacagaggctcttccttttggagattagacttaaacgaagaaaaatgtgcctgtcaattaaaaacatttattgaatgtgaactctgtgtagagcattatactaagtgtcatgtggagaaagaagaaatataaatcaaactgcccagtactgaggaaggaataagagaagaggaaatatatgcaactgtggaaggctactcattcatgatgaaggggctgggctactacaagtggtacagtctccatgccacatttgtatacagactatttgcaatatgtcttgccattaaaatatatgattagaagacttgctgctactgaaagtttttccagtgatcatgagagttttagctttgagatgagccagactgaccataatccctaccctcacccatctgacaaaatctggttgcccacctcaaataacataattcatgtgaaattatctaatgagctatgaaccaaaatacaagaaaaaaagatagttacttggttaatgttatggataagaagagctctcgtcagtgttatcattctgtgccatttaattacaacagttagcatacttattatcaggtatcaccttaaacactataatctagcactcagggaatgatagttttgagatgttctttagtctaatatactaataattactacttttatttaaacatgtccttgatgtgactgtccttagactcttaattaacacacagaaaactacaaatagaaattgaaaatgaatcacaatttaactaaccctattacataattatagtatctcctctagaaattatggtgaaaggatcttagagactaaagaacgagaacctgagctacgcctacatatgttttcaaataaatgttttgatatggtcatcttttggtaatttcagtattaatatggaaaaccagtttatctaaactaggcttttttgtgttatgcctgattgatgagactgtatgtactcatgcgagaacactgttttacaaaaaggattacgtctaatcctaaatagataaaaacagacatatgtttaggtataatcatatgtatattattttagccctaggttgtcctaaaactccacaatctcaataatacactgaaaggccttggtcatgaaaggcatcagtttaaagactgttcaaattaaaatcttagaaaaccattattagttagcaatattattaaagcattagaaagattacttactatatttaatggctaaatttttctaaatttctaaattatttataacattttgtatttaaattaagaaatgtaaaaataaaccttaaagttatatcacatctttcttaaaaagtaaaataaagaatttggaaactcccttttcaatatgcacagctacatgaatatataaatacatcactagatacctggtctagcctctcacttgccctcattaagttaacagtttcctgagaccagggttatgatccaaagcttacatattgacggtaagctgcatgaaaattacagctatccaaaaatgtctctagtaaaaagaggtactttgcaccatccaatattctgtcacatttatccaaccaattaatgctgacataagaacagtaaattaattttaatgttagttcaaacaaaaaatacagctaagatagagataaatcagttaaaaattataccaaaatttcatgccaaaatgccagaaacgtgatttttttttttagttaacactctccttttagtagcttctctttttagtctatgatcgtgaaagatcacttctactctgaccaaaagaactggaacatccataaggaaaacgtccatgtatagttttaaagcaggcaaggaatttggccaactcatttctttggttaaaaattccaaataaattagtaagaatctcttacggtcaataaactcttaatatacaaattattgctgtaaaattaatgatatggttaatattaactgttttaaaattctgcatacaactcttcacatttgataaaatacagtgaaaataaaaagtatcttccaattgatcataaaacttgtatgtgacactgaaaaactgtacatatgttactagacatactgtttctagaacgtacaactgatttttaacaatactttgcaccatcaaatgaggttcccttctacattgtaaccatggtaaattttgtactttcaacaaccttaacaccctatcctgtcttctcagcatatgtcttaaattccttcaacaaattgccttcaggacaaacagattttgttttctgcattacttaagtgatgttgaatcttcaatgcttcatagacatttagaaacggacagaaatcatttggaaatatgtctgatgtaccatttcaggtcaaaactgaagtaaaatttaagttatgagaaattattttttccatcttggaatttcattctaaaagcaaactgatgaattacaaaattattctaaatttttaaaaagtagtttaatcttagggcaaattattttaagtagaaaattcagtttgctatgcatataccagtatagatacatataaaatatagttcacagaattttttaaaatctataatagctatacttatgctattctacatatttttacactatgaatatatgttaaatattttcactgtggtaagcacacatcaaatttataaatatatacgcacatatttttattagtggcataataatatgagtggtttatacaagagtggttcatctttatcttaacttctgaggaaactatacgtggttaagaggaacagccatttacatgaggtcctaaatgaagcacactgattcagctctcattttcctttctatacaaaaagggcaagaatgtatgtgtcttacgtggttgtgagatttattatatctccatagcctaagcttgggaaggaagattctggacttataaatttaagagctttaatgcaataattgctggactcctagtttacagaaagcttcatttgtctttcagcttcatgagctacaccactcaactgtacttttgggctctatactaaaggagctattatgatttagggtagcagtccctctgaaatacacctgaaggggtacttcaggcacttaatatgtgtctagcttatctcacaatttgcacaatcacagaaaataaatattatgcaatttgttccttgaacgacaaaaacggaacaaatagataagttagaatatttgagcctttaagtaatttcataaattattttatttaatggggaaacagagctatggtcattttaagtagtcatcctagttatggcccaaacttgagcctaatgacgtatcagttcgaccatatctttactggtagaacaaaagggtagcataaaatttgattaacacagtcaaccaaacaggaatgtctcaaatcacacccctaccccccagtgttccctggtatctgccaaagttagcattttccttcagatggattattattttcacaccaaaattaccaacgttattacctcaacgactgccttaattttgcttttctaaacagaatctggtcaattaatatttactaagcacctactatgtgtcctgacttttctacatgcctccaaaaattagaactatgagggaaataatcaagaaaattaatattctcactagtcacacgatcatttaaatcctgcatgtagttttacttaccaaaaattaaaaatcattcccgtaatttctaaatgtttaaattatttctgattaattcagtgtaggtaagcttgatatataactatgacatgagaccatttaaagtatagctcttgcatcagcttattaaaatgaaaaagtgataatacagtttctagggggaacttacataacaactaggagaatatttttagatcacataattttatttaacatgaatatgctgttaagttgatcagttaaaattaccaagcaacatacatctaaataaaaatctactggtattttcattacctgttcttaaacttgttcactcaagtctcacctgttatatttgtttgttttcatttttaaccaaatacagtcagtcatgggactcattagaagaagaaaatgaattgattttctaggaagaccactgaacttttgaatgccaaatttgcaattaaggcaaaaaataacttatacacagaatttatgccccaaaatgcaggcagattctgaaaaaagctgacatgcacaacaaaaacatttgttgtatttatttatgatgttcttgtaaacgtcttctacaaaatgaaaaataatcttatttggaaatagcattatccctgattttcgtaaaattttatctggaaatatagtagtatagcaatgataatttgaaagaaggttgtttacatatcatgtcaatgacacatttggtacacataacttttgaggcactgagtattagaaaagattaattttaatttattcttgaaaaagaaagacaaaaacttggctagctttgtgcttttatctcactctaaaaaagttacttaaaagtaaaggttatcccgaagagacttcttttttaaatgagaggaagtgataaaaagtaacacagaaaatgtcatatatattattacaaaacaggaatgacggtaaaacattccatataattttagtgtttggaaaaacatattgcaaaaatgatttaaaatcagatgatgatcagttttacacatataacatgactgttaatgttttcaaatttctgttaaccttattttcttaaattatttggataaattctagcagatttgcattaaaatttatttctctgctacagactgataaaatattctaccacatcccattttcttccaatgaactcaaagttgaatttctcctaataatttccttagcattaaaaaaagaataataaaaaacatacaaacaccttttaatttaaatttgtatttaacaagtgcttgtctgatataattcagctgataaatatgaacctatgtgtttatcaaatccctaagaagattatctaaatcaactcgtgtaattaccattcaccatctgttccaccagggcctgagctgatctgctggcatcttgcagttttctgaacttctcagctttttctcgctctatggcctgcagcatgagagcaaagatgagtaattcaatacaaggactgtgaatctacacaataattataacttctacttgccctttcaagccttaagatgtttcactctgtcagcttatcacgtgaatctaaagactttttctcaacacttttgccatcaaaaacatcaaaatggcaataaaagcatgagccattttcatgacttgctacaacttttaattataagatttctactcagcttttttttacattatagtttctgatacatttcaacgcaagactgcaaaaagtaaaaaggcaattcataacaatgaaagataaagtgtcacataactaaaatgaaatttatcttttaaagatacaccattgaaattactaataagtatataggcggtattaaaaatcaaattgagaatccagtatgtatataagatggaaaaaataaactaccataaataatttagcagaaatatataatatatgtacatatatatttaaataccaggctgtaggctaatttttctttcaaaaataatcaaagtactcctatttccaaggaagacaagattgagtttcaaaaaactttctgaattcctttatttcccttaagagttacattttgaaccacaaatgcaaaattatttcagttaacaatagccagaatttcatactattgagtttagctaataatattcctatggagacataaattttaaactatgacagagtagaactacattactataatcatcaagaagtgttgactataacaatgtgtatgtcctaaaacataactattcaaataactataacgcaattaaaatatagtaagaacaacacacctgtgacttaacaatcatattataacaaagatttctcttgaatttgaggcagaaggttattctacatgagactattttttaagacttcatttacatccacaggcatttaaaaaaatatttccaggtaaaatactggagtacagatgggagggcaaataacagatacatggacagtctgcaccactgttgagtataaatttgtgcagggatggaaatgatctgtatctgtgtcatccaatatgatagccaataaccacatgtgggtattcagcacttgaaaggtggtcagcatgacttgaaaataaaagaatatttaatttaatctaattttatttattttaaataatttaaaatttaaaggttacatgtgaccagtgttaactgtgattgtacagcgcagatctaatacattcctttaaaagcaaatagttaagagataggcctgtaatccgagctactcagaaggcctgggcaggaagactgcttcagtccagggatttgagatcagcctaggcaaaatcgagagacctccatctctaaacaaacaattttaaaaaattagtcaggcgtggtgacaggagcctgtagtcccagctactcaggaatctgaggcagaaggactgcttgagcacagtagtctgagtaggctgcaacgaactatcattgcgccactgtactccagcctgggcgacagagggaaactctttcatataatatggcaatatcagaaatagttgcagagaaaaagtaatcatctagacaacactatttactaagcacattaaattatgtaaatgcttatacaataatccacatatttttatgtatctgaaaagactatctaatttaaagaaatagctacaaatgtaaagctttttgtttttgtttctctttgagacagagtctcactctgtcgcccaggctggagtgcagtggcatgatctcagctcactgcaacctctgcctcccgggttcaagcaactctcctgcttcagcctcccgagtagccgggattacaggcgtgcaccaccacgcccagctaatttttgtatttttagtagagacagggtttcaccatgttggccaggctggtctcaaactcctgacctcatcatccgcccagctcagtgctggggtggggcggggggattacaggtgtgagccaccgtgcctggcctgaataaaggttttcttaaaaatttattttaaagagtttcctaagtgggagacctgacgatatctgacttcaaggcttgatataaaactgcagtaatcaagacagagtaatattggcaaaagaacagacaggtaaatcaatggaacagaatagaaagctcagaaacagatccacataaatataatcaattgatttttggcaaaggaaccaaggcaatacagtggagaaaaagtctttaaacaaatggtcctgaacaacacaacatctacatgcaaaaaagtttatctaggcataaaccttacacccttcttttgttttaattacaattatttaattccaatttatttactttcatgttattcactggatcaacttcattggaagtttatacttttgatggtgaaatatctgacattattgtgaattttatcacaaattcactttaaaatttcaacattgaatatatctgtacaaatgataacatgggctgggtgcagtggctcacacctgtaatcccagcactttggggggccaacgcgggtggatcacctgaggtcgggagttcgagaccagcctggccaacatggtgaaaccctgtctctactaaaaatacaaacataattatctgggcatggtggcaggcacctataatcccagctactctggaggctgaggcaggaaaatcccttgaacccgggaggcagaggttgcagtgagccgagatcacaccattgcactccagcctgggtgacagagtaagactctgtctcaaaaataaataaataaaataaaataacatgaacatatatttttgtggaacacagcattatggttgaaaaccatgttttcttggatacacatggatataaagatgggaacaagaaacactgcggactactagagtggggagggagtgaggggaaaaggtccaaaatagtagctattggatactatgctcagcaccaaacctcagtgtcacacaatatacacacgtaacaaacctgcacatttactcttgaatccaaaagttgaaattataaaaaataaaataaaaatgaaaaataaacataccaaaaataaatacatttccactgaatttagaaatttgtgtaactgcttgaaagtaattgtggtgttcatataattcataaagttaattaataatgaatcaatcacagactctagagtaaaatgtaaaactataaaactcctagcagatagcagtggagaaaacagaggtgactttgagtttgttgatagttttttagatacaccaccaaagggatgatccatgaaagaaagaattaataagttgaatagtactaagttaaaaggttctgctctgtgaaagatgctgccaaaagaacgaaaagaaaagccacaggctcaaagaaaatatttacgaaagacatatctggtagagaattcttatccgaaatacacaaagaactcttaaaactcagtaacaaaaacaaacaaactaaaacatgggcaaaaatccttaacagacacctcaccaaaggaagtatacagatggcaaataagcaaatgaaaatatgtttcacatcatatgttaccagggaattacaaattaaacaatgagataccactacacacctattagaatggccaaaatccaagaacactgacaaaaccaaaagccgacagagaaatggggcaatgggaactctcattcatttctggtggcaatgcaaaatggcacagccactttggaagacagtttggaggtttcttacaaaagtaaacattctactatatgatccagcaatcatgcacttaggcatttacacaaaggagtcatatgtccactcaaattcctgcacatgaatgctgcagcagctttgtttgtatttgccaagacttggaaacaatcaagatgttcttcagtagatgaatggataaataaactgtgagacatccagacaatggaatattattcagtgcttaaaaatgagctatcaagccataaaaagacatggaagaacttaaatgcatgttactaagttaaagaagataatctgaaaaggctatatattttaccgcaggatttcaccctagattccaattccgaatatatgatagtctggaaaaggtaaaactatgtaaactacaaaacaatcagtggtttctagagattaggagagaagtgtagatgaacgggaaaagtattgaggatttttatggcagtgaaattacaccgcataacactctaaagataaatacatgtcattgtaaatttgtttaaactcacagaatgtgtggcaccaatagggaaagctaatgtataaactatgaactttgggagataatgatgtgtcaatgtaagttcatctgttgaaacaaatataccactctagtgggaaatgttgacagtggggcaggctatgtatctgtgggagccgggttatatgggaaatttttgtaccttctgttcaattgtgctgtgaacctataattactctaaaaatggagtctattaaaatcacaaaaaaaggtttcatgaattaggaatactggattcaatatcaagagtacaaaatgctaaaaaaaaaaaaaaaagccaatcattcacagaataaactccatcaggaatagctgtaatatataaaatactaattaaaactgagaataaattaagagtaaaatttaaaaaaaatctataaggtagtaattttgttttattttcttaaatacctatctcttagctgaaagatacacattttacatggtgctctgaagggcaacaaatgaaaactcagttttgtctaattagttaagaaactctgaaagtgacagacactttttaatatcttacattccacttgaaaatttcaaagcacccagtttgtggtattttgtgattttatgttcccaggatccctttccaattagcaggtaaaacttctgagttgtcttgaaattcagtttcacaaagacagtattgaattgtttccaggaacgtgcacaatcatggatggttctaatttgttggttgaactgaaaagtccatgaaaatagagtagctacaacatctagttaaaagtaagatcctagatgaagctccaatatttctattttctcaacttattagtttttgtgatctaagttatctgtccttagcagcttatggcatacttgtttttcactacttacatttattctccattaaaaggtaaatgttatatggaaagcaccctgagcatcttagaggagaaaaaataagcacatttaagtaaatatgtaatgtaaatatcaagaaagacaggaggatttggggtgtccagaatttgaactttatccagaaaacaatatacagatgaaagaaaaaatatataccacaatacaacacataaaggaacaatgacaacaagctgagtaaagtgatgttctttgagttacttttagagttatcttctcctatcagaggggtttctattttatctacattgagcttttgctttagtttttgtgaaatgatataaaaagtagaatgagaacactatgtggtctttataaatattgaaaataaattatcaatagccctctaaatgttatcatcataatctctttattctaagcttactagaatcaattaatattactaacagagaacaaaacttatatttgaatatctcaggaatcatatttgacctttaatatcttgttaaccacattgttccagttattctaatataaatagtctcagtaacaaccaccacaactacaacaaaaacaataatctataaagtaggtactattactttcccattttgacagaggagggaagtgaggcacagagaggtttgtgaaaattttgaaaacaatgcaatagccacattgaaaataagattccttatactaccaaattatagtttatgtacataatttccatatgtatgtcataataattgtaagaaagaagaaatcagcattgttgtataccattttatacaagagaaaactgagcatcagtaagattaaatcgtatatcaaaggtcatcatattaggaagttttagattcaatattagaaccctgctcttctacttataatttcagctttctttcagacatgctctgctgttgctaggggtatttcaatggatattattcaaaaaggtgtgagcgtatcagaatatatatcagagcaaacagagcttatagtttggatgtattagggatgttcaacatatttaactattaattcagcagggccaacaagatatcacaaggaatgccgggtcactcagaatggtctctgacagtctataggctgattaccaactctgtatacagctcaaataaactgaataactggtgcataaagagacacatagaccccagaaagaagcagtcaatggtatctgcatatttgtcaatgttcagacgatatctgggttctgttagggcacattactttcaagaggaacattgcaaaatgaagaggaatatgcatacaagtatgccttgaagagtgtgaatgagacagtgaagagcccagaaaacatttcatttcagacacagctgtagatagttgattaaaaataataaaatttagtataacaaagagatgttaaagaagatactacaacaaaagggcctgcagtcaccctttttgctctgctgttatcagttctgtctctactgcttactatctgtccctaataaagtacttcgacctttctgaacctcagtatttcctatgtaaaatagcaataaagatacctaccatgtgggacttctgaggggattaaaggaagctcgctatttatttcccaaaatgagatagtttttatagtaaaatggggagctaggaataattaagctgagaaaaatggtttgacataagctaagactatacccgacaaactgaaatatgtgctcattctacttaaaggtaacttcaataatcttaaaaagaaatttaggaaactttttttttttttctttttgagacggagtctcgctctgtcgcccaggctggagtgcagtggcgcaatcttggctcactgcaagctccgcctcccgggttcacgccattctccttcctcagcctcctgagtagctgggactacaggcgcccgcaaccatgcccggctaattttttgtatttttagtagagacgaggcttcatggtgtcaaccatgatggtcttgatctcctgacttcatgatccacccgcctcgacctcccaaagtgctgagattacaggcgtgagccaccgtgcctggccacggaaacatttttgacacaagagatgatgagagtaccttgttcgtggaaatgtccaaataaccacatataaaaagtgttaaaaaaaaaaaaaaaaaaaggttaagtaaataaacatcactgaaaatcgccatttctcctgggatctggccacccatacgttcgtcctcaaatgaaatatatgaacttctgttttcaggtaggttggatcagtagttcctaaaatttctaccgtctcccattaactcacagaaatatacattaaaaagcacagaaaagcacaaaaaccaaaaacaaagtctaaagagatatattttgctgaaaaaggaagataactgtcctcattttaagtgactgtgtatcaacaaagaggaacataggccttccacaggtctatcttgcaaagtaaaaactggttcaaaacaaaaacaaaaactggctctcacatctattctcttactcagtcccatcaaaactgctcttatcagtctcaccattggcccccaagctactgcattcaatgactgatgttcagttctcactttacctatcaccatgatttgattgagaggattcctttttcttcttagaagtatttgctaatttggcttcacgtactacttgaacacagttttcctccaacttcagaggtcacctttcctccatctcctttgcaggttcctaatcatgtccctgagctcgcactttggagtgtcctaggcctcaatctgtgttttcctttgtttaggccaaaaacagaatcctccactcccctctctctctcaagcctcacattcaatccatcacaaagtcctgttggctctaacctcaaaacatagccagaaagtgagttatcatggtgctcactactaccacattagacaaagtaccccatcatctctgaggggtatgaatgtttcaaaataggatactaaaggtctttatatttcaccctttgttctctgattatatattatcaacacagcagacagagacaacaggattcagctcaactcgctgacagctgaataaaagctcaagtccttaccatggtctgatcttaattaacttccttaacctttctgaattcttctgctgctaaacatcgtgatttttctgctgcagccacacgcttaccttttccctgatgctacaggcatgctgctgttacacggctgtgcatttatttttccccatgcctaaaaaggccctaaattacttacttggacattttcccccatcaaatgccactttttcagctaggccttttagtgccactctgtctacaagcacatgcataccctctcattttattctgctccttggaacttatcactaacattccacatgctttacatattagtcttgcttcatttccatctttcccactagaatgtaaactatataaggtcaggtatccttatctatatccttctctactctatcccaagtctccatgaaagtggctggtacattataggtacataataaggcgagctctattttagcgtaacgcgtccatatacaatattatggtctctccccttacccacaatgctctcttaaagtgcaaattcataacgaactctaatagctttatataaagtggccataaaaccagtacatggggacaggtgctgcaagctcagtaaaggaaggatggattaaatcaaagtattctagaaactgcatattagttagggagttgggcacatccatcttttcttcagctcaagtcctgatactggtaataaaccaatacctaagtagaaaagaaagagtaccatatacaatccatgagtcaaaacttggtagaatcttacctctctgtttttatttcatggctctgatcttccacctcctctctctatgtgtgtgtatgtacatatatgtacatacacatacatactgtatatatacccctttcccatgttttcaagaccaagggtatcatctgaatactcttcaaccacagtcttcattttcttttatatatttcatcttcaatgaaatttggactaatattaccatattagtccaaattccagtatttcaatattactccaaatacctacagtcagacttcagccttcactactgtacaaaaagttattttgtgaaagtcattaatttggccgggcgcaggggctcacgcctgtaatcccagcactttgggaggccaaggcaggtggatcacaaggtcaggagatggagaccatcctggccaacagttgaaaccccgtctctactaaaaatacaaaaaattagctggacgtggtggcacgtgcctgtagtcccagctactcgggaggctgaggcaggagaatcgcttgaacccgggagacagaagttgcagtgagccaagattgcgccactgcactccagcctgggtgacagagcgaggctccgtctcgggaaaaaaaaaaaaaaaaaaaaaaagaaaagaaagtcattaattttcttcttgttaggaaaaatgcttcttacaacattcagtactgataaaaactacaattacctcctcgaaattgccatgttcataaaaatacctctgcccttgacaatattatctttctcttaaatttcgtcctcatgaagtcatccagcttttctgtatgtgtgtttttctatagagctgtttatcatatatgtgtctacatgcatatacatttttaatcttgaaaggatctatatttcataacatacagtttttaaattatgctattaacatatagaatactaaatactttactcaatatatgcttaatatatgatcacatgtttagaagccactactcggattctaaattatttagtacacataatttcaagtaaagtatacagaagctaaaaaaggcatcagtaaatcaatgtatcagaaatgagtgattattgtgggctcatgaaaattcttagagatcatgaagaattataaatactaaaatgggtaacctaaatgcaaaataaaaggcaactaagttatataatattcaataaaaggaagaaaagtaaaataatttgaagcaaagaatacaacacagggaagttcacaaattcctcaataagttgattaaaacctctttcagacctctgttcctccttctttattagcacctcttaaaagcctcctctttctgtatcttctctaacattatgaaaataagttatggatctctatcagtcctactccgacattagaagtaattaagaatctactcatttaacattctataatgaagttttaccctttgactgaagagtaacttattcactcaaatgtttattcagaagttgttctatccttcatattggtaatagatcctatcttaaatgcaactgcagaactgaaaaaaatcacatatccatatagttaaacatttattggtttgtgtgttaggcatggggacaccaaaaacaaaacacacacacataaaaccaaagccacttcacgttcaagtcctgatttctagaaaccaacaatggaattgaaatgaaaatggctagaaattagtttgtgcaagtaaacaaaaattagatcattgtaggctttaagagggcaatatgaagacatggactttgtcaacactcttcagacaaagaccactggaacatatttgtaggttatcaaagttaacctgatttacacgctgcaacgagagagacagcgcatcacagggaactatggggctgtctctaagagtatgttagaaaaagcttattttaagatgtgggcttgtgttacatgatagggggcatcaaggaagtggggctttgttttgattggatgttgtaaggaagtagggtaattctatgttgagtgtcctaaaatttttatctagatggcaggaggaatgcagagaggctaaagctgtgtttagtaaagaagcataatgtgtcacattaatgaagatgagggatatttggtcattaggcgtggtttggacaatgctattcttttttactgtattaagatatgattacaaagtggtcttgcttttatcttgattcatcacaaccatagcgtgtccctgtatgatgctggcatccctagcaattatttatattcaaccagagaacatcagactggctgcaagtaccaaggcaacatctagcagttccaaagcctaactgaagtgccaagccagctcctggctatcagtagctgattttatctttctcaaatgattataaacacagacataacaagatcatactgaggttttaatatgttcgctttggcagaggtgatgtggaaacttctaaaggaatataacattagtagcagggaagaccagctacaggattgtcatcttaaatagaagtaagccatgatattagctttaatcagggttttggtgatgggaatagagagaactggacattttcaagagctgttaagggagcaggattaattgaacctgtcaaagattggacttgtgaatggtagaagaaaaatctaggtgacccagttcactttcaggtttctggattaggctgtttgcagggtgaaaggaaggagaaagaataaaggaggtctggggaaataatgagatttaagatatcaggcaaacatcaattaaaattgtctattaggcagtcagatatatcaccctgggttttaagaaagagatgagctaaagatacatatgggagaagggttcatttgaaaatagacactatttgaatgggaatgaatgaggatatccagagaagaaacacaaggactctgaagaatatcaatattaaagaaaaactgaattggaacaaatggccaagaatgtgaaagaattaatcaggagaaagcagtatcccataagccaagcgaggaaagaatttcatgagggaaaagaggttaataggttctagttctacagagggattgagtaagataaggcacgttaagtattcacatgcatgtttataggagaggacacgttctaaaagatgaaaacacaaccggtttaaaagctaatgataaagacctgggatgtagatttttgacaatctggatatacagctgaatggaaccaggtggcttaatacatagtcagtgatgctgctgagaacacacacccagagatgagcctcaaccaggtgaaggatagcctcttccactaaggcaggtggaaaaaaaaaaaaaaaaaagatactatgagcacaaatacccacaatttgagaaatattatttcgactaaagtaggagatgaaatcatttactgtgaatgatggggaaagtttaggtaccccacaaaagcttgaaataattgttgagagaaactaagttgaaaatatacttaggatgcacggaaagcttatgaagaactgctggttttgttaaaatatgttgttagtgccgggcgcggtggctcacgcctgtaatcccagcactttgggaggccgaggcgggcggatcacgaggtcaggagatcgagaccatcctggctaacacggtgaaaccccgtctctactaaaaatacaaaaacttagccgggtgtggtggcgggcgcctgtagtcccagctactcaggaggctgaggcaggagaacggcgtgaacccgggaggcagagcttgcagtgagccgagatcgcgccactgcactcccgcctgggacagagcgagactccgtctcaaaaaaataatcttattaaagaaatggagtaatgcctgacaatgacaacatctacatacatacaatcatgacagcaggtagctgaattgaggagatgagagaaacaacagcttttagtgatagcaggagagcccacagggatgctgaaataactaagaatgaaagaacaaattggttgaaaaaatctactaacctagtgccaaagtcttcaatgagaaaatatgataaaatggtagataagagatggccagaagtcattaactgcaaggaaagaggtatttttacatgaagagagcagtatctttggaattgtctctgttaggtgagggagtcagtcattctaaagtagtgggggtacaaaagagggatgagtcatagtgctgttttcgagggtaaaattggtttccacgtatgagtagaataagtatatagaaggcttgtcttgaaaaagtgtttgagcctgccgagtgagagtgtgggaaagcagaggaagtgaagcaaggaaaagaaagtgcaatagagcagagagagaaagatagaagaaaatatagactcgaggtacctatactctgggtagtaaacacagataacagagataggagaaattggaagcattaactggcttgatgatttccagcgggagttggtaaaaagttgattctgaaagagggtaatcaagtgcagatccgaggaagagcccaaagccagatgaccataacgacttgatagggagggtttcaagagaacctcacagaagctccagattttcagacaccttatcaaatccccttgtgatcaaaggaggctattttttttgtttgtttcattaccaatttgcgttaccatgtgctcacggaaaaaattcgagttgttagaatctgttaattcagctaaaaagtctgaactgcagtgatactaaaagaatgtgagaggtaactgctacgtaaagcccaagattgtgtcctagaatattgattctcgagcctttatgtgcataggaatcactcctggaaaatgttcaaaggcaaattttgatttactagttctgagattctatatttctgacaagctcccagataatgtcaatattggtggtccagggacattttgattagaaaggtcccccagaagtcagcttttaaataagtgcattttgttaattatatgaataaaacacatggtgaatatacaaggaaaaaattatgcttaggtttaaaagttgcattttttaaaatatgtgaaattgaactgataatggcctatgatatgctaactggctaaaagcatttgaaaggagtaaatgaagaaatcaagtgaaaaaaaaaagagttggtaatatttagccatttttaatgaaagcctaaaaatggattaataccactcaagttcatgacacgagcctgccatgagtttaaaataacctatataaaccgacaggtgatgtagtaagaaaattaatggatacctaaactgaatatccatcatcgtaattatgtatttctctcaaggatttttaatacatatacattgtatttagcctgagggaaacatcaaggtaaatcatttcatgtcccattttagtaggcaattaagaatgatgttgttatttcagaaaatgagagttcaggttgataaaggggactcacaaggtatcagaaaaccagttataaaacactgtacatttttgagcacttttagtctgtcatgctcccgctattgataaaatgcaaatcgttcataggtaaccacatgataacaggaacttttaaaatttatattcctgaaatactgaaactcaattttcctgcctgatcaaagctgtcttaagataaagaaacagagtatcagacagaaacctgtgagaatcagatcaataatcatttttaattagctaataaaatgctaaaggtgattcatactttcagtggtcaaatatgtaacatgatgtttgaaaattagagtttaatgttctctaattaattttctactactaagagaatttccctcaaaaatcacagcaaacaatttaccttcaaagaagtatacttgaaaaaagacatttagctaattttctacaattatatattatctttcagttttcatatttcccatttcttgaaacaatttagaatagtctattataatgctgacaacagcatgtcttataaagctaataagtaatttaaaatagctttccaatttataagtagttaactctaagaagaactggtgacaaaattgtcttccctttttcaagcagcctaaaaaatagattttttttccagaatatatatatatcttttgttgatctccaaaagttccaaccccaacagcaaacattagcttgtaactgaggtaatgtcgtatttgtaaaaatacaatggattttgaacttcatgatttgaatcctggagagaaaaagcagagctaatatacacatttagatgtgatcttcccatggataaaattacttttcattcataatcactgcttccttagcttgcccattttatttactctgcctgttagaaattattttacaaactgttgccaatcatatacaaagatgcatgttttataattgttgaagttgaaaaattaaagccttgacaatttccctaaagatgaaacactttatattaaattaataaaacttcctatttgtgaaggtcaaaattataccatctcagaagggaataacaacaacaaagcatctgctaccacatgtaaatactgagaaaggctggacaccttttagataaggtaatacacaaatatctgggaaatttaaatatcttataatatatgacagggattgatgactataaagaataactttttgataacagtgagaatatagacatagtcctaagtatggtatctattatattattctattctattttactctattctactctacacaattgtgcaagcttgctaaggcctagccttgaggtaactgaacaatatatgaaaggaatcaacatgaattaatgtcataaaattgttaatttatagttaaataatatgtaagttaaggcaagtttatgaaaggcatccctagtcagtcacagaagaatccagaaagatttctctaggctaaactttgattttgcttgctatctaaaatatatttttaagacatattaaacagcattttatcatatcgcattaatctatcaactagtagaatcacagataacaaagcacggagtttacaagcagcacaaaatgagtacagatataaaaattaatgcataacctacattgactttttcttttaagtctgagaagttgccttccttccgaaagattgcaaattcaggactctgcaacacagcttctgagcgagtaatccagctgtgaagttcagttatatcaacatccaacctaagacagcaaaaaataaaagtcattatttcttgattatctctttcttctatattaaaaaaagcaatttatccacatttatcattcttttctcaatctgagactcctgcctgacacctctattagtattaatagcagcactattttccctgttaggtagactcaaatttggagtcagctttgatctagagtcttatgatcacagaggtcattttattcacctcaatgtaaaaatcacttctacaatatatcctgtaagctattacccagcctctgcttgaatgtttccactatttgaaaaagtactacttcccacgataaccttttctttttggaaagtatttatgagaaaaaaaaaattcctgttggtggtcaccattgaaacacatgcttttctgtagtctccaatcatactgcctctgggtttggccacgtgactttctatcacaaatgggacaatagtaagagtactgcaagtaaggttttgagaagtgcttgcatgtcagagcttgactttttagagcacacattctgagaagacaacaattatataagaagtacaatgaccttgaggtgatcatgttttaaggaaacttgatctgtccatgtgaagaggccacatgaagaagcatggggcaccaggcatgcaaataaagccctctgtgacccatctcaatgccagctgaagacagacaaatgagtgctccagttgatgccacatagagaaaagaaatacccaaagggcactgcctacgttgaagaattaggagaaataataaataggtgctgttttaagccactacattttggtgtgagttgttatgctgccataaatatcagatcacctatcctgttattttcaaacctttttttttttttttttttttttttttggaagagatctttggagccaccagggataaattattcattctaatctggtgatttaggtatagaagagccaaaatatggaatcaacccaagtgtctaatggaatagtattaagcctttaagactatgaatagcctttcatttgcaacaacatgtatgaacccggaggaaattatgttaagtgaaataagccaggtgtagaaagacaaataccacatgatctcacttacaagtggaatctaaaaaaaaaaaaaaaaaaaaatcaaactaaaagaaacagaagacaatgttcatttccaggagctggtgggggtggagagtagttggaaagatattggcaaaaggatacaaaattataaatatttgaaatccgctctttaaatttatcagtagatacctgatcatcagcctaccctatgcttaattacttcaacggatattctatggcttgttgttatcttagtttccttaaattgggtacttaaagggaacatatcagcagtgtgtaaaataaacagggaagaataattatctttctggtttataatactttcattgatatagcccatgatttcaataaatattttcacttcaatattagactttcaactcacattgcaattcaattgacttaaaacttctaggaattttttcacataaactatcattaaaccagttatatcacaacctaattactatcacaaacatatgacctgatctattgaactccagttttgggactttgaatcatataaaccagttagaatttctcacatttgttgcaggctattgtttaaaaattaaacagatacagaaattaatggaacacaaagcccttagaaaaacatattcgcattttatattctcacaaaattctttggttaggtatcaccaattccagctgcccataggatgagatggagcttcagagaaattaagttaattgacctcaataccatgggtcagaaacttgacggttcatagcatacagattgagttgttatttatcgaggctatccaacttgaaattaagagactagggatcctgattcctctaaatcccatgtcactgaatgtcagtaagttatctgtgtatgcattacaaatgtttatggatttttattgtgtcatatatgatttttatctttcctacattttttatccacaagtttgactatcaggttcctgtttcttcattcataatgttgattaaaatatacagtacaattatatgctgtaaaaatctttcacactctcttcagcgatgttaactccttaaatactctcctactatggttatttgattacctacccaaaccagtgaattatatttcaatcatcttttatgcatatttatcatcataatgtcttaaaacatttttatttttgctttggcccaacataaaatttcctgtgtctctctatctgcaagcatctatttgccagtatattggacagagaaggagtgctggaatgttaatactttaggggtgtcccttaaccagtgagagcttggaattggtgaatttcccagctcccttgcccctcagttggacaatcctgaagtatgatacacagtgtctcaaggggttccctgcatgattgagccccagttccttccagcagtaacctgatccctatatttgtgccatactttattggctgctttatttttcttatttcacttccctactttgtttcctgggatcactttccaaataaactgcttgcacctaaatccttctcttcagatctactcttggggcaacccaaactaaggcaataatcaacagcctcaaatgaacctagcatcctgccatacttttttttttttttttttttcccaagttgggctctaagtctctacaggaactattaaaaccttttatcaaagctctggcccatcctctttctgcagctctctcagatgatcttgttccctaccttacagaaacaagtgcaattatcagagtagaacttctttcacttcctatttccaaacaccatcagacccgcatatgtagccaccgttctcattcccttcttttacatttgagtttcccttcttttaattaaagtcattcccactacctacattttgaactttattctcttacttttgctcaagcatctgagtccatccaatttctagtatttgtttattttgagacggagtctcactctgtcaccaggctggagtgcagtggtgcaatctggtctcaccacaacctctgcctcccgggttcaaggaattcccctgcctcagcctcccaagtagctaggactacagttaacactgttgaccatactatccgtttgtaatttttcttcctttggcttcatgatgccactctattctaatttgccttctatttctatgaccattggtaattttttctttgcaggtccatcctcctccaccctatcattatgtactagatgtcaagacctagttcattaccaatcatcttctactctactatctctcaccagaaaacacatcagtcatcatgccttgaattgcaatctatttatcaatgattctgatatgtatatctctaattcaggcacttgttctgaattccacagctatataaccatctgcctattggatgtctccacttgcatgctgcaaaatctccttaaacattatatgccaaggtttaaagtttgatcttctccctcaaactagtactctatcagtattccccagatcagtaattagcatcaccatccctcatatttgttatcttcatctccgctatggactgaattttgtgccccacaaaagttcgtatgttgaagcctaattcccaatgtgatgatattaaaagatggggcatttgggaggtaattaggtcaagagggtagagccctcatgaaatgagtccccttaaaatgatctgaagagatcagtgttcttttccaccgtgtgagggcacagtgagagagcaccaagtatgaaccaggaagcctgcccttaaaagacactaaatctgctagttacttgatattaaacttcccaaactccagaaatgggagacataaatttctgtggtttataagctacccagtttatggtattttgttacagcaaaccaactaaaaccctctctcttccttcccatgtttaatgtattgcaaagtctaatctgtcacacatacattctctgtctcctgaatatgtatgcttcttcctgtctccatagccagaacccaaatctgtgttgccattaaatgtgaccaaaaataccgcaatagcttttcacttggcctctgggcagtatttatggaactctctcttttatgtactactggaaaaattatcatttctatcttttttaattgacgcataatagatgtacttagattgggggtacatgtgataatttaacatatccgtataatttgtaaagatcgcatcagtgtacttgggatatccataatcttaaatatttgtctatgctagatacattcaaattattctcttctagctactttgaaatatacggtagtaaaaacatatctgattatgttaccttcattcgtaaaaccactcaaagactttctcatttttcttagaataaagaacaaaatttcaacatgatcctttataatctggccttcatagacctcttaactgtatattctactttgtcttttattcaagtacttgtagaaacaaatttcgcttcatattttctaaagtaattcagagctattctttattcttgttcctcctccaatggaataaaatccttcactgactcttccataaatattttgaaaactgggttgttaatataatgcatttgggccactttggtgaaatttatttgtctgactcaattatacatcaaataccctctgactcataaatatgagataggaatatccaccagtcactttcaaattcacgctttaaacttaatctctctagtctcaccctcatttgatttagactatctctaagaaagattgctcacttctacttagaggtccctgaaactcaaacgtgcctcaaggtactaggctggcatgacagctgaaagaaatctgctgaagcctatgttggagaaagatttctactaggcgttgaattgacattgctcttgtttgcacactgtaggggctcagaaaacgataccccaaagtatggcactttggcatgctgaaactttgaactaaagaacactggaaggcctcaaaagcagcctcaaaaccaaggtccctctgaccttctcctcccctcctgtctttaactccacattcttccctgaagtgagtcatagtaaccagaattcttcttcttcaaggtaggtcatagaaaccaaaaaccctctcctccaaagccaaccataaaagccagaattataactctgtattttgcccacctttctctctattagctagccataaaaaattctctgacatacttttgtttgatagtagatcataagaccctcattcaagtggggtcctaccccatgtgtaggaggaaggaattctacacagacaggcctggctggttgtccctagtctattactatcagatcattccctttttgtccaatcacattcctacatggctgtctactctttatcaactctaagcataaaaacagttttcctttgggtcattgggtcttcatttttgaaggctcccatgtcacctaaaacttttattagataaatatctcatgcttttctcttgttaacctatcttttgttataggaatgtctgctatgacctgtataaggaggaaggaaagggatcacagcctttctgctcctataacatgcatgttgatgtaactgttataccaccacctccaattcactgcagaaaaaagaaacaaagttgtttgtttttagtttgaaagtaaataattttcattccaaaagaaatcttttttttttttttttttgagacggagtcttgctctgtcacccagcctggagtgcagtggcgcgatctcggctcactgcaagctccgcctcccaggttcacgccattctcctgcctcagcctcccgagtagctgggaccacaggcgcccgccaccacgcccggctaattttttttgtatttttagtagagatgtggtttcaccgtgttagccaggatggtctcgatctcctgacctctagatccgcccgcctcggcctcccaaagtgctgggattacaggcgtgagccaccgcgcccggccccagaagaaatcttgtaacacttttagaggtgtattttcctgaaaaaggcaaaattgtatgtttccttttaaaacggtcaaatgtctcctttttttccccttcataaagcatatactaagtgcttactatgtgccagacatgctattaactccataaagaacagagacgagaatgcattagtccacattatcaagtaatttggtttagtgaagcatttgtttgacaagataaaaatggtttagacacagaactggggctcagctcacactggtctttttaagaggataatcaaaaaacaccttctctgtaaattaggattaaatcagcttctagcctagaggctctgccaagtatattggttatctccacacaaagaaggctttgtggagtcaacaccatggtaactgtctgtttgcttctctgtctgtgaagattttaagggaggcctggacaccagttggcacgtagttctgataattcaaatcaattcaaacaacaggatgtgaaattctacagaaaggtctttcctcattcaattttttgtctgactttataaatttggaaaggggtcacatacagtgcgtgaacttcccttttatacaaagatcgtatggagagtgattacgctcgttttttgatgtacagatttttaaaaaggcaatttcaaattttactagggcagtggtgaggagagcgttttgtctaaggaaaataacctattcataagcacagaggttaatgttatacttcttttctaaaatggaacaaagaaacatattaatgagtttggactcttctcacctgttggagttcttccctttcatttctatcattattgtgatatcttgatttcatgggaaacaggtggacactgaacccaattcttacacaattcaagctctgagctattcctaacctaatcttaatatttattttatgttgcttccatttggacttcttccttcaaacatctctgatttccttgctaaaactctttttgtccacacataatgtgcagtcagcctacactctaatacttaacatgtaccaccatctcttagagttctgggagttaactgtcagctactagcattgttttctctccaatattctgccagtggatagcctcatctctttatgccagcaatgaggatggaagggtgaagaggaagcagaggcagggtttcaaggcctcccatgtactctccctgagtgccaatggcctacatccaacgcttagttttaggttcagtgacattttcaatgcacaatgaactcagtctccttcccggatcctactcagaccctggcttccaagaagcaattgcacgtttattttattccttatcaatttagcaactatcgcttcatcactttttgtggtttgtcgtgtagttttcatgtatttcactgctactagatattcctcagatatctttgctgagatgcatggcaaatgaacagacacctctgatttaaatgtcttcatgctttaaattgggtgctatctactcttcccagtgctttgcagatggcattttctatcatactttgcactaagtgagcctgggtatttaattacgaacgaaatatatcattcagatgcaactcagttaccttctttaaaaccctcaaggaaaacactgaagacttattttcaatgccatattcaacgttggattctgtacatgtatttttgcttcttcataaaattactcgtttctaataattcttttttccccactttaacaactcacataaaaccattgctaatgaacttatgtatcataagttgctcataatgtgtccctacacctttggaatcagtccactaatatattccttagtgcttaacttactttcctcatatacttaactctgtacttaacgtacttccgaatgttatcagactctatcccttaaatgcagtctaactttacctagcttaaaatctcctttagctaataaaaaaataacttctcattctctgttcacaaaatgattatttctataattattgatgaatattctgtcctctattcttcaagtatatcttaaaacctcaatttgttattatttatggttagcagtgaagcgacaatttttttctcctttacaaatatactcatcagaaacccctgaaattaaaacttgtaaagtcccatcatacagggcaagtaagtctttgatttttttttttcttggcaaaagtgtattactacaccaagacaatttttcaaaaagaccttccattttttggaagtttcaaaatatcaaaagcctggggcatatataccaaatattcagagagtgacaatttttctcagtattatattgtacaaacagactcagcctcatccagttgaatttcccataaaaatgatgtaaattaggttaattacatcccatatggtaaatactgagagatacctgtgtatataaatgtttaaaataaattcaaaggcaaaaacacatacaaacatctcaaagaactagagaaatgtttgccatttaagaagttgtcaattttgaattgtcaatagtaaaacattacatgaattagtgctatataactgtgctaattatgtcagaagagcctcctgatgggcactgtgttctgttaattttctttacagtgactgccacataacctattaaactaagatgacacatttacataaattttaattcagtcactttcaatatacaagttgcaactcatcattcccaaatgtgtaaactttgagagtggaagtcctccaagctcccagacttaactaatttgattagtgaactaggtttatgaatggccattttacatatttaaacatcttagcatgtagaatttcataaaaacttataagcctcatccttagaaacctgaaaggaaaatgctgatgcctgtgaaatacgttaaccattgcagggtcccagggctctaggcctagaccagataatttatgaaaccaattcttaatgaacattttaattagctaggaagcaagttttaacattaataggaacaaaactataattattctttgttggtattaaagaagaaataattttggaggtaagattttccaactttgctgtatttttaaaaatcacctttcttcttcagagttttccgaagtgagaagacattttaattccatattactatacaggcactttcctgaccctaaatccccaaccatttgaagatgacctactattcatcttccaaggctcagttcaagatgcacatcatctgtgaaggttttcttgatcaacctctctctactcttcccctttcaactttccttctgggaaaacttgtccctctctgcttgtttccacatggcatttgctttaaaaaaaaatcgagtaatagaatacaaattcaatttgcatcaaatagatcttataaaaatatcaaatgaaattcagtataaatcctattagttctaaaaatatttttaggactttgagatgcattgactacatggcaattattatatttttggaattacagaatattattaaaggggaaatcctatttaaccaaaagaaaacaagctaatatttagataaatagttccctctccaaatcaagatagtttgtatacacacacacaacacatacacgtttgtatagtgtaagtgtgtctccctctgtggaaggggggaagatagggccacatgattgtcttgtattttgtaatatgtgtgatacgtgtgtgtttgtgtgtatgtttaagttgctttaaatgtaaagtaaatgtgcatttaaaaatatactgagctgagggccaggcgtggcggctcatgcctgtaattccagcactttgagaggccgaggcgggcagttcacttgaggtcaggagttcaggaccaacctggccaccatgacgaaaccccgtctctactaaaaatacaaaaattagccagctgtggtggtgggcacctgtaatcccagctactcgggaggctgaggcaggagaattgcttgaaccagggaggcagaagttgcagtgagccaagattgtgccactacattccagcctgggcaacagaacgagactcagtctcaaaaaagaaaaaaaaataacatagctatatatgtgtgtgtaaatcaggcaccacaggttttaatccctaatttttatctttctggtattttcttgggtaaattaatttcttcgatcttcagcgacttcttgctttaaattgtaaaaatttaaaagctgttatcaaactggtcctgaagtaaaaacatactgtaaaccaaaaataaaaggctaactccccctccaaagggacttcctcctcagccagggctcttaaaatttaacctgaaagactggttcaggccaagaagggaagtgggggtcagacatgcctcattatacctctctgacacttacatcaacacagactttaagtctgataagaagcactctacagcctcttctctctgaagcctgctagctaaaagcttcatctacatgataaaactttggtatccacaatgtcttatctcaacccaaacattcctttctattgatcccaggtctttagacaaactcaaccaattgtcaaccagaaaatgtttaaatttacctacagcctggaagcccccacccccacccagttgtcctgcctttctggaccaaaccaatgtatttcttttttttttttttttttttaattttatttttttcagacggagtctcgctctgttgcccaagctggagtgcagtgacacaatcttggctcactgcaacctccgcctcccaggttcacaccattctcctgcctcagcctcccgagtagctgggactacaggcgcctgccgccacgtctggctaattttttttccctatttttcatagagacggggtttcactgtttcagccaggatggtctcgatctcctgaccttgtgatccgcccgactcagcctcccaaagtgctgggattacaggtgtgagccaccgcgccaggtcaaaccaatgtatttcttaaatgtacttgattgatgtctcatgcctccctaaaatgtgtaaaaccaagctgcaccccaaccaccttgggcacatgtcgtcaggacttcctgaggctgtgtcacaggcgcgcgaattccaccttggcaaaaatcaactttttttttttttttttttttttttttttttttttttgagacaaagtctcattctatcacccaggctggagtgcagtggcacaatctcactgcaacccccgcctcctggggacaagcaattctcgtgcctcagcctcccgagtacctaggattaggcaaaatcaactttctaaattaactgagacctgtctcagattttctgggtctacaatacaaatgctttttaaaaattacttgtaaatatgtttacttacctctctaattaaagaggttttgacccaagatacaaaaactgagatcagctttgcttatattgtggctttcatattccaattacattagtctattcatctagcaatcaaattaaataaaatctaaagatgttataattcccagttataataaaaagcctataaactcttcagtggtttacacagcacctggaacaatgtgacagatgacagaggactctgtcttcagttagtggaaactgctatattaacattcctatcaaaaatctatttttccttatatttgcatggtctcaaatgtatttctagttttatatgtgtaattttaagcacatcactcataaaataatatgtttcagtacagtaaaatttaatgatttcagattgcactgaaaggcatctttaaaagatactaaaaaatcaatttctgtggcgtttaccttgtcctaaaatatgcctatttaacatgtgcctcaaaagctgaattctagtccaagcacaaaatattgtccttaaaattgtacatcttctttattatcaattatggcataccgaattatatacttagtatgtttaaaaattctgctttttaaaatacatgcccttgcatacaaattgaatgatttaatgttttaagctattaatgccaaaaatgtctgagttatttggtattgatattcatcttggcacccatagaatcgttgattgcagtgaagagaataaaactgctgtaaaatattgcttctctgcacaaagtaaaacttacctaaaatattttgacgtctggtaggtagaaatgatgttaaaataatcttcctaccttaatttggtattaaatcttaatcatttcaaaattcattggtaatatttatttctaaagtgtgacatgattgaacagatgtcacatttataagttttgtttaaatatctttgagagaaacaaccttaaaaattaaaaggtaagaaacccccacaaattctaaaatgtcagatactgctacattagaggaattagttataaagccaaggagtgtgaaaacacgtgggcaaaaactgcatgacccagaggatgggaaataaaatgctgctaagccacagatgcctaaagcctatttttcattttcaataaattgaaagtccctttgaaacacacttctgtgcaagaaaatcaccttaacacaggttaatagaaatattctcttaaatgatagatgaaatcctgtcagagtaataaatctatgatcatacaatataatatactcaagttgaaaatcctgagtcatatattttaaaatcaaatgtaaagtttatttaaaatgatgaaacccaaaagctgcctatgtccttatgataaataaatgtgggtcactagagggcgcacattccctttcagagcttgtcttcaatttggcttctttcgttttcttatctgcataacgaaaatatggtgacaaatgaaattttcatggaagttttacttacacagaaatataaaatgtccaaagatatagataaaatagtgtacaaataatatgtaagtaagacactctcagatgcactgttaaaatgccttcagccattttgaggtacacacaaaagtaccttgaagccataatacatagaatcccttgagaaaatatgtccacagtttggagagtcatgcttagttcaaataatttagtaaaattttctggattatgtagcaagtagttttccttcccaagttcattgattttaactaatttttgaatgtttagttaaatatgtggacactcgtactctaaaaatctgcttaaaattatactcctaaatcacctaaagttttttaaaatgccaaactttcattcaaatttaaagaacagaaaagagacatatatatcattttaagcatcttaatcaggtcacaggctttcaaaaagaaaacttaatcgctcaagaaaccttgtatgttatctgtaatagcttttatttttgcagattgatcatgaatagaaaagttgaagatcttcatttagtttcaatacacagtgaagcactgagtcaagactcaagaacaggtctgtctgaatccaaagatttctacaacactacatttttcttttgttccaaataaacgagaaacccatcttaaaaaaaaaataaggataagtcaatatagaattactgttcattgctacacagtacagtaatttagtggttttgactacgctatcttggattatatgagaatttgattgaagtctctaatatcaggatattaattctgaaatttttcattaaaatatgatccttagttgtatactttgtaccctaatggcaatataaaataatttatttcccaatttattattaccttggaatttcccttaatttcctaaaatcctcaactttctaatctgatgatacaatttctcacatcagagaaaatattaagcatagatgaaaaaagttactacttattatataatgtggttaagaccatggtgagctccaaaagtcttgcacttggaaaaaaaagttcaattatatggaaattccacttatttttgatgctgaaaaagacatctaaattttaaagaaatcttttcagtgaaaaaggtctctgtatttaaagataatcaagtgttgccatgggacactagagtcaatgatacttcagaatgtagaacagacataatctagaataagtgcagcttccatagactttggcaaattcttaaggagtcccagtcaagcattttatttcagctaaataatttgatgaaatcacctttaacttattacaacatagcaaggcgaggaatttccgaaggcaacaccctaagctaggctgtctgggttcaaatcctagctgcgatgcttcctgtaaactatgtgaccatgagcaagtcacttgaaatttctatgacacattgttatcattggcaaagagtgacaataataaaacttacttcgtaatgctattttaagtgtgaaatacattaatatgtagcaaatacttggtagaagccatatacatattagctattgttattaatatcttccatgatccttttttaactggctttaagccctatgccatttctcactttctcacgtgtgagagtagtcatatttgttttagtgtcttcttaatgactgataaagtaaaagccacaattggaataacaagaataaaaactgcaaacacagctataacaaagacaatgaaacatataaacaaaaatcaacagcaaaatagtctcattttacccattagtgccggaatccccaaagtatgttctatgggacaaatatggtctgccatctaatttggtaaataaaattttactggaactcagtcatgctcattcatttatacattgtttatggctgctttctagctatagcagcagagttgagtagttttaaaataaattttatgatacacaaaacctaaaatatttactctctggccctttagagaaaacttttctttcccccttcccagtctatgaaaccaaggtaagatggcctctctctcccaactctcaagtgagatcaaaatgatatggttcacagtagccatatcatatttctctctctcaaaaatatgcaatggctccccatgaccagaaggtttaagtctacatgccttaatcttttattgaatacctttagttattatgaactcaacctaccttttcaacctcattccttacttctaaacttcctttacttcatacttctgctggaggcaaacaagaatacttaatcccatgtaagttttgttcgcatacaggctttcccctgcaatgaattgtcactttcctcatcttgagcccaatgcttccctactctttaattatccagtcagatgctaattttcccataagtcttccatgcctctcaagcaggaagtgaacttttcttccttaaaacttttctaacattttattagtacttcttcatgacagtttatgctgggtgcaagcttcctgagggaaagcttagatttacagttaaagtaactggagtgttttacataccatagcaatccattagatattagttgagtgaataggaaaattagcatgaaaactaatgttgctgtctcttctttcttgaaatgatgtggactcataatgactacagaagtgttcaaagaaacccaccatgcattggatgatgacttggaccctgtgggaggcaatttaaactttaaactctctcagtgtgaaaggtccttgagtttaagagaagtcaacatgcttgtgggtctttcaagtttaaataacttccaacccgggttccaaaaggatctagtgcaatgtggaaagccatttcaatctgacgtgtacttaatgccccactgccagcatcatgacctgtttcaatccatctactgtgttagtaagcatcactatgaactttagtcaaaacagaagtaatactcattgcttaacaaagccggtttttagtcagctagcacttacataacaaaataccatagactgggtggcttaaccaacagccacttatttctcgcagttctataggctacaattccaaaattaaggtaccagcaggatcagttcctggtgacagccttcttcctggcttgtagacagcctctggtatagtttggatattcgtcccttcccaaatcttatgctgaattgtaaactccagtgctggaaatggggcctggtggcaggtgtttggatcatgggagcggatccctcacggcttagtgctgtctttgcgatagtgagttctcctgagagaactcacttacaaatgtgtgccacctccccctgcactgtctcactctccttgtcccattcttccatgtgatgtgactgtttcccctttgccttccatcatgattgaaagcttcctgagacctccccagaagcagacgccaccatgcttcctctacagcttgcagaaccgtgagccagttaaatcaattttcatgtaagtcactcagttgcaggtatttctttataacagtgcaagaacagcctaagacaacctccttcttgctgtgtcctcccaaggcagggagaaagagccagcaagctctttgttgtgtcttcttataagggccctaatctcctcagaagagccctatcttcatgacctcatctaaatcaaattatcttccaaagtctccatttccaaattccatcacattggagattagagcttcaatataagaatttagggaggacacaattcaggccatcccagcctggcatcatttttatatctctgtggtagcataatatgtgttcatttgtaaagagacaggtttctgaccagggaagactttactaagaatactctcagaagatgtcagaataagaataatatataaatgtggtcatgggaagataccatccctgaattaataattggaaactcaactttctcctggggaaaggagacattgttttttaaatgtaaacgttcttcaagacaaacacatgtaatataatttccacagtgtgagggcaaacagggaaggccatatacattccatttcaggggtgacgaaatagattcttggggagattaagtggcttaagtcacatagtttatgagcagaagatgcacggccagaacccatctgtgcagtaatatgcccatctgctctcagatctattccccacatttcttctgtactttctgtattagagggatatacatttcccaacaccacttgccctcctaattgttcatttggaggcaatggcagaatattggaaggtgggaggaagagaaaagccaaggtcttttttcttctccaactaccttgggtggcatttctagagcagatgtatctctgctgtggcttctgttttctctggatagctagctccctcttcaacaatccaattttctgcctggcagtcctaactttagtttaatctctgttagaaagccccagcttctgagctctggtaatatcactttttctgtattgtttctccagctctagggatattagcagcttccttacgttactagtgctttgagttgcctctccatcccctgcgctgcgtctcagttttctactacctgcttagccaattccttatattacgtttcctctctttaaatcacagtgattttgtttttctgacaagactcgcacaaaacctggaaaatccctcatcaacatccaataaatatttattcaatacctactatgagctgacttctgctttatgcattataggtgtacagatgacaagaaatgatttcttccctcaaggcgtttactggagatacaggcatgcaaaaataaagtcattaccatacaatttggcaagtgttttaatagaagtgttaaaaaggctgagaagtggcctggcactgtggctcatgcctctaatcccagtactttgggaggccttagcagtcggatcatgaggtcaacagatcaagcccatcctagccaacacggtgaaaccccatctctactaaaaatacaaaaattagctgggcatggtggcccttgcctgtagtgccagctacttgggaggctgaggcaggacaatcgcttgaacccacggggcagaggatgcagtaagctgagatcgcgccactgcactccagactggcaacagagtgagactccgtctccaaaaaaaaaaaaaaaaaaaaaaaacacacaaatggctgagaactgcctctgcaaggttagataaccagaaagacaaggtggttagtagcacggtggcaggtaacatgggaatgggaaaaagaaaggtatctaaagagaatcttaggcagagaaaacagtaggtacaaagaaacagaagcttaagaaagcacagagcatttggagatcaaagagtggttaatttaagctaaagcatagggcagtgcggaacaaagttcagactttagcagacagtgaactgtttgctattagtctgtaagaagaaaagagttttcaccagagtataaatcaactgagtcactgaacaaacgatttgatcttattttgcttttaattgccgaactttcttgacaaaggaaggagtacattgatttatattctggctcaagcttcttatctcaattgtggactggtactaaaaagtttgcagattatttggagtagcactggtattttttttaaaaaaggagcagaggagaagggagtgaagctggagaggtaggcagctaaagatcacaaaagaatttctacgccatgcatttcaagatttatgggcaggggaataatctaattaaaactgcattttaagatatccctcgggaggctgtaaaaagcatggataagagaggtgagatcagaggcagagaaatcagttaaaaatttcatacagaaaaatttcagttttaactagagtgaaggcagcaaggatgtagaaaaaaataacaaactaaagagaatttaacaggtacatttggagggatttagtgatgtggcagatatcaagaccactgtgaatggctgcacaggttgctcactgcacaagttcaggatgtaccattcttagagactatgatgtgaatgaccctctctagagttatacgatctaaactccaaaactatattttagattccagtcagaaatccaggaatacatagcctataagcatttgaattatacagggatgaacatcaggagagagggagaggtagaaatatcaatttgtgaatcaaaaatataggtgatgataaagattataaatgatatttccccaaaaaataaagcatcataagaagaaaataaaatcacaatttgagtcttatgtagactgacattaaagggcaggaatagaagacagggaagatatactctgaaagaaaacaggagagaacaatgtcccagaaactgcaggagagaaaaatttcaagaagggactaatcatttctgtcaagcacaagacaaaggtcaaaaagggaaaagaactgaagagtgacctttggagctggcaattaaggagctctctggcgaccttgctgagagcagtttcagtgctcgatgtagagtatgagagggtaaaggaaagaatcaggagtccgtaagggaatacagatagttcaggtcttctgattaaaaactgacttttatttgcactcaactatgcttctccttttagatgaataagtatgagtaccattttcttcactcaaaaaacgaacaaaattatatgtaacagctctgggaatgtgatcctgtcttctttcgtgttgatattcttttacgccttgcattctggaagaatacattttcacatagctactgtagccagacatccaaagatatagtatctcataggaccagttctcaatatagtgcatttctattcacagcttgaattgagcatctactacacagaagacatcacacaggtaacgaacaagaaatggatcctggcccagggaagctttaattctagtggatgaaacaagcatatggatagatcatttcatcataaagcagtaaggtgtcacaagatgcaacagtagcatcccttaacctgcccaggaatagatggcccctgtcaggcctctgagcccaagctaagccatcctttcccctatgacctgcacctttacgtccagatggcctgaagcaactgaagaatcacaaaagaagtgaaaatgcccggttgctgccttaactgatgacattccaccattgtgatttgtttttgccccaccttaaccgagcgattaaccttgtgaaattccttctcctggctcaaaacctcccccactgagcaccttgtgacccccgcccctgcccacaagagaaaaatcccctttgactgtaattttccactacccacccaaatcctataaaacggccccacccctatctcccttccgtgactctcttttcagactcagcctgcctgcacccaggtgaaatagacagccttgttgctcacacaaagcctgtttggtggtctcttcacacggacatacgtgaaagcccctttatgggggctgtcataaggaaagagaatcaggggtcagactgtaaatgacaagacactccagtgaactgatttccaaagtgtgggccctaaatcagtagcagcagaatcacgtgggaccttgttagaaattaaaattcttgggcaccactccacgcctattagaattagaaactctggtgactccgacgcatgctgaagcatgagaaccactgttgtcatgccagtgcgagggttctcaaattttatggtgtataagtatcaccgagagtgcttgtaaaatatttttgggcccaccagcagtgtttctgattcagcaggtttgggaagggccctccaaatctgcatttcaaagaaggtcccaggtgatgatactgtttcatgcactgcagtttgaatattactgttctaagtattctctgatcccatagcattctctagaattcacattactatattcttcaaaacactgctattgatttattcttgatgcataagacaacataatctcaagaacatttaatagatggttatctttttgaggatgtgaagatggtatgcaagatttctatttcttttttttttttttttaacaaaaaatagtgtctaaagcgaaatttgaatttatgaccaaggtcattttcctttaatacataaaaagtaacatgacattgcaactataacactagaatggatttaggagagtcagcaccagtccttattttgcaactgaaagcaagttatttaacctttctggacctcaattaacctgtaaacatgcataagtctagtctccttaggaaaaaaagaagcaaatcatctaaaatgttttgtttctatgggctgtgccaataggcaaaagtgtcattactgagtttaacatcccagatattttaggatcaatttatcatatagaacattaaaaaaaaaaagttcacggacacattaattatctaattaggtccttcaaataacttggtatattttgccatacaactttcagattttagtttagaaactgaagttataatcaatatctaaaacaaaaatgttttaggcatgagtctcacaaaactgcagagcggtcttatctgttatctattttctttccagagatgtgacacaatttaacttcatctggacagcagccataaaaagaaaatcaaacaaacaaaaaacagaaacaaactgaaaagtagaatatataataataattcaggtatgtagatcagtcaatttatcctcctatgtagttaggatgcaggaaatagccgagaaagcaagcttacattctgtctgcttaccctggagggaaaaaacagaccaggtgaactgaggcatttcaaaatgcctctacattatccttgaggacaaagatattcatttatgaacgctttacttgggggaaattatctttattaagatggcattcacttaaaaacaatttgccattcattctgcctggttgctacaaaagtataaattaaagctttttttaaaaatcccttaaaataactgctacatgattaggaagtaatctcctggataaataccaattaactagataatagatctagttttaccctaggctgagttccttactctgataattacctacgtgtacaataatatcactgaattgcaggaataatttgctattagaaataattatcttgtgacccaagatcatcagacacttttgcaaatctcagtgtaaagagaaaaatttatgcaataaatacaacatatgtagaaactgtataattatttaggaatcgactaaatgtaccttagatagttaagaaactatgtggtagaaagctgaattttaaatcccttaattgttttgggtaaataaggataccctaatgggtaaaattggaattattaaagatcatcaggatggtcacgtttattattaagaacaattccaggaagagctaggtagaatttttaaatgatattgaaatgtcaaattttagttactgcaattatttgaattatataccattcactctctcaacaaacatttattggttacttattgtatccacggtatttgctacaatggaatctaagtaaaacataaagaagtgtaataataggcttcctttgttttgacgggcaatgagaaattttatgtgagtggcatgaaggcatacaacaaaacgaatgtaatgtaatttactggctgaagtggaataatgattattgggaaggtagacataaaattagtggagaatgagaataatactgaatgccataggaagcacttgggttttattttggaggtatctggatttatgggaattcgcatgtctggagagacatcaaaaagcatcattttagatatattcattttagtaaatcaattagaaaggagggcagttctctccacagtgaggtatatggctcaggttatggacttggcaattcgaatgaacatgaaatgacggaaatgatggcacttgcccaataatacaatctaattataataaataaggaaaagaaagtagaagaaaaattcacagaactagagatgtcaggtggtaaattctgttttgaagaggaaaacaggaaggtaattttacatttcttaggtttgagataatgtttattatggaatttttccctgtcgataatagatgactaccatctccatcactacctccaccaccatcatcatcatctctactatcgttacctctcccaccatcacttctactcctcctacccaccacaatcttcctccatcttcatcatctctatggtctccaccaccaaataagaatcgaaccactgcatttattgaatgtttaccaccttaaaggcaatgtattaaatgcttatttaatcctcatgacagttgttttataaagtgagaatactggaatctgaggcacagataacaagtaatttgcctgcgctcataagctagtaattaaaacaggcaggtttcacaaataccacaggttcttacctataagtgagagataaacactgagtacacatggacacaaagaagggaataatagacactggggcctatttgagagtggaaggtgggaggcaggtgaggatgggaaaactacctatcagatattatgctgattacctgagagacaaaattatctgtacaccaaacagccacaacacgcaatttacccatgtaacaaacctacacgttaaccccttgaacctaaactaaaagttgggaaaaaaaaaaagggcagcattcaaacctcagtaattctgattccaaaagcaatgattttttccatatttgctacttctctagacacacaggcaatgaattataactaaaatatgtgtgcaatgtataagtaggtatggttaattggaaggaacaaatgtttgcatttgatgaacattgaggcagttgctggatgcacaagcggaaatagctttagagatataaagctttaatttgagggagagtgtcacatctggagctacatgatttgggagtcagtcacttagagccaggctcgaatcaatgagaggagataatccagataaagaagtcaaaaggccgggcatggtggctcatgcctgtaatcccagcactttgggaggctgaagtgggtggatcacgaggtcaggagctcaagaccagcctggccaagatggtgaaaccctgtctctactaaaaaatacaaaaaaaattagccggatgtggtggagggtgcctgtaattccagctactcgggaggttgaggcagagaattgcttgaaaccaggaggcggaggttgcagtaagctgagatcccgccactgcactccagcctgggtgacagagcaagacactgtctcaaaataaaagaagtcagaaaggcaaagagatggatctgtgtgatactcccataggaataaggcagaaggaataaaacaagtcaggtaaagagtcgtgggtgacaactggtagtgtgtcacagaagctggaagaggacatcatttaaataaaacactattcaacagatggtcaagacctcaatattcagtgaaatattagtgggcttcagatgatacaaaaacggggcactagctaatataaagcttatggttatatttgcatgatgcctctttaatcattacaatactttaacaagattccaccctgtagacaattatcaattaatgaatttgttcctaaatgtttgcctttttgctatcttcgttcagtctaaatttatcaatcaagtgtcgtatatagcgtgttcagataattttgccgtccaaatcaggacacacttgagagtgaaagttgatgctatatataattatgctgggacaacaggtgtaactgggatggcttcaggtaaatcaataggattaccttagtcatatatctatgaaaaagacattttactatacagcccaggttttgtagctacctcagttcaaatcctgtctgaggtacactgtagctgtgtataattttataaagtaattatagccatacctattttgggaggttactgggaaaaatacatgcgatgccaataaagcactgaatctactactgagcacataataaatcctcaatttatgttagcttttatttgaagaatctttctgtatgtgcccaatgggacttctcatttaggcacatacaaaaattgccgaaaacttatgatacaaacaaattttggagagaaggtatttcaccactagccactctttcctgaaaacaaaaagaagtcagaacacactttttttttttttccaacacaatccattctccaaacaggagccaataataagcttttgaagacagagattgacatgaatcagcttgctctgttaatttctgtattaggcaagtcctgaagacattaaaagtgttaggcaactaggtgtccctattactctgtttggagaactgttggagggttgttggaatgttgcaaagtatccataaatctgtatgtccactaagcgttgtctataaacacatgtttaatgtgacaacaaacaagttaatgtacatcttactaggaataataaaagaaattcatcaaaagcttcacggatttgtgccattatgcttttcactccatcaatttttgttagattttctattaccatcgtgagtagagtgcttggaagttcctgaaagttgttgccacaaaaagaatgctaatattcatagagtttgagagccatttgactggagcaagggtcgccaaactttttctgtgataggataggtaataaatattttaggctttgtggactatacagtttgtgttacaactattcaaactctgccgttgtaatgcgaaagtaatcataagtgataaataaatgagtttggctgtgttccactaaaacattatttataacactgaaatttgaattttatgtaattttgacatgtcataaaatattatttttcttttgattattttcaaccatttgaaaacgtaaaaacacttcttggctgatgagccataccaaactggcagcatgctaaatttggttagcaggtcttagtttggtgacccctggactagtggatttgcttagccaagctgacacaaccagggagaaaaggcccagtgatttactttggaattatcaaagtaggtcataagtcattagttaatagagaagtactaaacatcccaaataatatatttgaataacttctctagatttattttttttcttagaacatctgacatggtatttttagatgtgtgttcttttcaaacttctctaccctggtatacacaaattctaatgtcaagtgttccatgagtttctaaacatatgctgcttaaaaacatacggcagattttaacgttctttcttaatcttagaattacaataactggaatgaaagggaaattgtaccttttaaaataatttttatgccagctttgcactcataaaattttattgccatcattttaatatatccactgatttacataatacctaacttatctaaaatgcataattctgaatagtcacaaaaagatcagttaaaaattctaacaccttcaagataagactttataaatatcaaagaacaggaaatgtgttctgtaattactcctgatttaggatgcgcagactgagacatcatgttctcgtaaactaccaggatggatcccatctattataggtgtacttcttcatgaaaatgcactttccgttactggaaaaaaaagacatttaatgcaaaactagggactcaacaagcaggccctttataaggaagaaaaaaaaaaaagaaagaaagaaacttttaggattaaaatgctaccacagtagtttatcacctatagtttctatagtttcttctttcaccccagaaaacaccatttccattaagcatttactttctgttgcgatagtgatttcttgtgaaagttttaaaatgtacttcataatttttctcactacattaactgacattacaggtacccgaggattctggaaatattgctgaagtgaaaacaccaccaacaaaactgctgtaaatgagttttctccacttcatttgcagataaaagcttaagatgctctcaccttttcctaatttcagaatccacagtaatctgcctcttcttttggggaggtggtggtggaagttcctcttgagcatgctttaccaggatctgttcccttgtggtcaccgtagttactgtttccattacagttgtctgtgttagtgatggctgagtggtggtgacagcctgtgaaatctgtgagaagtattgaaacagaggtcagacattgctagaaagacttcagtaaagactgcttggagtggcaaaggaaaataatgagaaactgttcttgcttgttggtagattgaccttcagatcaaaatagcaccatattgaagccaaataaaattgttttatctgacttaagtttggttcactgaaatagcaagggaaagtaatctcaacatcgaaagtcaatttagcgccccttcaatatattggtcaaactgtaggaaataaggggtgggggcagaggagaaaaatgtagagtataattcattctgatagttaattctacatgctgtttaaaatgtttacattaatatgaatgttactaacgtacatcagtaccaattccattgcctagaacattttaaatgcttattaatagtttgtagaatgcatttttggttatcatacacattgattattttatgttatacatttttaaataaaattatttcaacttggtaatgaacgactctttaatcaaataagtgaaacagcttttaaaattacaataaaaggttaacataaagtatgtattagtccatatatatctttatgttgaatgttattcaaatgctaaaaaacacactactcttgtttgatttaaattagtgattatgttcaaatatttgagttcccatattcatcactggagacacttcttggtttagaatctcaattacctcctgttcatacttttggcagcgggccgggggcaacagttcatccatctttggaataatacattttgtgagccaagacatgagaggccatcacctcaatacatgggcattacgagatagacaagtcatataatggtgagacaatcattccttatcatattctccgtctcacagagctcctctcatgacgattgtaacgttacctcttgggatggtaatcattatccttctggcaatccaacttatatgcaaggtctgtttccaaggaagtcacaagaggcctgcattgaaactgcctctggttacaagcaaaggagcagggatctggctgggtcaagattcattttagcaattttcctgaatttgccaagaggtaagggaagggtttgtagtaatctccctgcctcatacacgaggactgattcctttcatgtgaggaaatgggaaaagcctcaggatcttcttatttcagcttccaaattggcaatgaacagtgaaggaataaaatcttttccatgatgtcttaagtaaaaattgctttgacatacatagcttaaaaaggctaccttttgttaaagacatatctttacctatgtgagggactgaaggatttccattttggtaggctaaaaggatactaagaattacagtttctacatttgccaagcacaggttttatcttctctaggatctccatagattcattatttagaatgaatcactgaacctcaaacaactttaattataagtctgttgacaagttatgtcaagatgaaagcagaaagcaacatagctctaaaaaaagcttaaaatataaactcaaacattgcacccaacacaaaatgaccattacgtgataaaattagttttatttctagtcaaaaagaaaatgtagtttttagtaggattccaagagcatttactttgtaatttgaatattttttaaccatgagaaaacttgctttgcaaagaaaatgcagtttttagtaggatcccaagataatttatttttttatttgaatatttttttaaccatgagcacactttctttgcatacagtggaggctagaagataatattttgcagattaagaaaatacctaattttaaacatacagaccagaatgcagagattctgaaaataccaagctaattcatgcagttatatccaatctcatagaacatttgtgctactaaaaatttgactcttaaattaatttctgtaatattaatattttcgtggtatctacttataaaattggatacatgtgcccatggagggtaaagggaaatgacaacatgatatactgtgaagcggcatttaaaaatatactcaaccttttaagaaagaaaaatgaatcatttttaataaaagagtagtaagacatgagtctgtaattgttctatataataatcactactacactgtaattgaaaaatactacttcatttccttcgggatggagaaataagaaaactgtgcattcaccctgtaaatatagggtagaactcattacatataacaaattaataatcactctcaaaacctacttcatacaatcagaataaaaaacaatcagtcatgtactaaatttccttatggcttatagttattgactataactattattgacacttaattatgtgttagaatcattaggaaatatagacaggagagggactacgaaggccatttaacatgacctcctgattattacagagctcactactccctgaaacagaaagctcctttcttagcatgcaagcaaactttccccattgggaaagatgttcttaacaaccagaggaatcctgcctgattaagacttcctcttgttaaaacttgttttgagttctgaatgaaagcagagtaaattgaatatcatttctacctgatattctaagatttgaaatctaataatcatgaccctgataaatatcattttcaaactctataatgccagttatttgctagaagtagatataacttgattcgtcatccaaaaccaatgtttcttggctttggacaccatagtcaatcaaagaattctaaaactgtgtaagttattcagcagctgaaccacaaggtttctataaaattctaatgtttattgaatatatattcactataggacattcagaaatgagtaaaatagaaactccatatttaggaaccttacggcaaaatagggacgatgataatcacacaaataattgtgaagatgaatgccacgtgaaaaataccagtatgcaaaataattacatacaccaaacatacagtaatcaagtaattttctctttaaatgttatgaaaacagatttctctcagctagcattttaacatttagatttaatttgatgctgaaggctagatataatatttatccttgtttatagggtctttctaacagtaacttttggaaacaacctcatgtcatagatgatggtttaagtacattatggtatatgaatgtggatggagtattatatttcaaatattttaatgtcattggaaaacgtttgctttacactattgagtaaacaatgctagacataaacattggttgatttttgacagagaaagtagagaaaatttctgttgcacagtgtatatttctgtattcctttagtttccaaagttcttctataagatattatctgcaaaatgttgcatttgtaagcaaagaaaaattttgaaagttttgccaaactgtttgttttaaatctatcatttctatttatatattaagatctatggaatcatactcctgtcactcaatgcattagaatgaggaaaacttcaagcatgataagaataacgtagtgccttcactaaaatgtttaatatggcagagtcaaaactagaatagaatatagtttgacctatattcaacaatctttgtatctagctaactatacttttacccagtcacctttcttcattttgattatgagtctatttaagactctaaaatgatatcatgaaaagaaaatacatttctttttaaaatactattcattttaactgcaagttaatttccctagtaaaaatgggaaatagtttagaaatacttgtctttacatttgggagctgattcctcttagagtggttataagtagaggcattggagccagtctccacaattattaaacaccagatccatagtttatacactgtgacatttggggctggttggttcttatctcaaatctatgcattattttcttcatctttaaagtaagagtaacacatttcttcacaggtgtgttacaagcaaggacagcttcatgggctggtaatttatgcagttgcccagggcccctgctcaggaggcttccatgcttgttttcaagctctgcttccactgtcttgaaattcttaggtcttgaacaggaagcccttgttttcagtttgcactgggcccacaaattatgtagccagtcctggttttgagaattaaatgatataatatctgaataaaataagtgctctataatggtaaatatcagcagtaaccactatcttttctaaacgctcagggaaatttgaagaatttttctatactcaaccttcttactcataagattacatatgttaaaaagatttaaactttaaaatttacattttctcattctgagaaaaattggaagagcatttgccagcatcctgatattattccagggtgtgcctcttcttgcagtaagattgtgttattttgataggcctgggaaaaacaaactatgctcaagaaatgaagttctttctttccatcttctcttccacttgtttaaaaaatgcacatttaaaaaaagaaacataagtacatcaaagcaaatttaaagaatacaaaaggacatacaataaaataaaatactttttttctaccactgtctccagtttattaggaatcactacaagtcatgtataacttaacaactgggacacattctgagaaattcatccttagacaattttgtccttgtacgaacgccgtggagtgtacttacacaaacctagatggtacagactactatacggccaacctatgtggtacagcttattgctcctagctacaaacctgtacagcatgtgactatactgaatagtgtaggcacaatggtaagtatttgtgtatccaaacatatcgaaaggtacaataaaaatatgatatagagagttgggcataaaacaatctttagaaaatttttttaaaacccacaaaattataccaacaacactcttggaccacagtgcaataaaaatagaaatcaatgttaagcaaattgctcaaaaccatacattaaaatggaaatcaaacaaactgctcctgaatgacctctgggtaaacaataaaattaaggcagaaatcaagaaattatttgaaactaatgaaaatttaaaaagatgtaacataccagaatctctgggacacacacaaagcagcgttaagaggcaagcttatggcacgaaacacccatatcaaaaagttagaaggatctctaattacaaaacgaacatcacaaggaacgagaaacaatagcaaactaaccccaaagctagaagacaggaaataaccaaaatcggagctgaactgaaggaaaatgagatgcaaaaaagcacagaaaaggtcaatgaatctaggagctgtttctttgaaataattaataataaagatagaccactacctagaataataaagaaaaaaagagagaagactcaaataaacacaataaaaaatgacaaaggggatgttaccattgaccccacagaaatagagaaaacccttagagactattcataatgaacacccctatgcacacaagctagaaaacctagaagcaatggataaattgctagaaacttacaactttccaagtttgaaccaggaagaaatggaatcattgaacagaccaataatgagttccgaaattaaattaggaacaaaaagcccaccaaccagaaaaagcccaggaccagacagattcacacctgaatactaacagatatagaaggaaaagctggtatcattcctatgaaaccactcccaaaaattgaggagcggctccttcctaactcattctatgagggaagcattgtcctgataccaaaacctggcagacacacaacaaccaaaaaagaaaacttcaggccaatgtccctaatgaacatagatgcaaaaatagtcaacagaataccagcaaacccaatccagcagcacatcaaaaagctaatccaccatgatcaaggagcttctatcccagggttgcgaggttgattcaacatacacaagtcaataaatgtgattcaccacataaacagaacaaaaaatcaaaaaccacatgatcatttcagtagatatagaaaaggcatcctataaaattcaacaccctttcatgttaaaaatcctcgacaaactaggcactgaaggaacatatttcaaagtaattagaaccatctttaaaaagtccacagccaacattatactgaatgtgcaaaagccagaagcattgtgcttgaaaactggcataagacaagggggccctctcttacaaatctcattgaacatagtactagaaatcctagccaaagcaatcaggaaagagaaataaaggcaatccaaataggaagagaggaagtcaaattatccctgtttgcagacgatgaggttctatactttggccatagtctctgcccaaaagctcattgatctgatacacaacctcagcaaagtttcagcatccaaaatcaatgtataaatatcactagtgttcctacacaccaacaacatttaagctaaggccaaatgaagaacacagtcccattcataattgtcaaaaagaaataagatacctaggaatacagctaagcaaggaggtgaaacactgctaaactgagaattacaaaatattgctcaagtaactcagagataacacacaaaaaatggaaaaatattctatgctcatggaagaatcaatattgacagaatggccataatgcctaaagcactttttaattcaatgctattcccaaaaaactaccaataacattcttcactgaataagaaaaagactatttaaaaattcagttggagccactaaaagagccagaatagccaaggtaatcctaagcaaaaagaaaaaagctggaaccatcccattgcctgactgcaaactatactacaaggatatagtaaccaaaacagcatggtacaaaaaacagacacataaaccaatggaaaagaatagagagtcgagaaataaggctgcacacctacaaccatctgttcttcaatgaaatcaacaaaaacaagcaatgggaaaaggactgcctattcattggaccccttccttacaccatatacaaaaattaacccgaggtggattaaagacttaaatctaaaaccaacaactataaaaacctaagaagataacccaggtaatgccactctggacattgaaactgcaaagacttcataacaaagacaccaaaaacaattgaaacaaaaacaaaaattgaaaactgggacctaattaaactaaagaacttctacacaacaaaagaaactatcaacagagtaaacagacaacctgcagaatgggagaaaaattttgcaaactttccatctgacaagggtctaatatctggaatctacaaggaacttaaatttacaagcaaaaaccaaacatcaccattaaaaagtgggcaaaggacatgaaccctttccagaaaaagacatacatacagaaaacattcatatgaaaaaatgctgaacatcaataatcattagagaagtgcagatcaaaaccacaataagataccatttgacaccagtgagaatggctattattaagaagtcaaaaaatcacagatgctggcaaggttgcacagaaaagggaacgtttattgcactgctgatattagtgtaaattagttcagccaccgtggaaagcagtttggtgatttcccaaacaacgaaaaccagaattaccattcgacccagcaataacaattattgggtataccaagaagaatataaatccctcaaccctaaagacacatgcacatgtatgttttattgaagcattattcacaatagcaaacacatggaatcagcctaaatgcccatcagtggtagactggataaggaaaatgtggtacatatacactgtggaattctatgcagccatgaaaaaagagattgtgttctttgcagcaaacatggatggagctggaggccattatcctaagcaaactaacacaataacacaaaatatcacattttctcacttctaagtgggagataaacattgagaacacacggactcaaagaaggggacaacagacacggtggtctatgtgaggctggagggtaagaggagggtgaggattaaaaaaactacttattgggtactatgcttattacctgggtgatgaaataatctgtacaacaaacccctgtgacatgcaatttatctatatgacaaaccaccacatgtacctctgaagcaaaaataaaagtaaaaaataatatagtataataatattatgagaccactgtcatatatgtggttcattgttgactgaaatgttgttatgcagcatatgactgtagttgcaattacgaactattcagctattctttaattttaaattcattttgtttatgctgttattttatgatatggtttggctctctgtccccacccaaatcctcatgttgaattctgtcttcagtgttggaggaagggcctggtgggaggggactgaatcatgggtgtggacctcccccttgctgctctcctgataagagttctcatgagatttgtttgtttgaaagtgtgtggcaacccttgccagatcgtggccagtctgcttctttaagtgggaccctgatccatcctcctcactgggtgggacctccctgagggggcttcagccattccacccaggattcaatggatagagctctgatctctccctgggacagagcttctgggaggaagaccagctgccacctctgcagttctttgaaactaatgagaacaaagagacaatttatcagaatctctgggacgcagctaaagcagtgttaagagggaaatttatagcactaaatgctcacatcaaatagctagaaagatcttaacagcctaacatctcaaataaaaaaactagcaaaccaagagcaaacaaacaagaaataaccaagatcagagctgaactgaaggagataaagacatgaaaaaccctccaaaaaactaaatgaatccaggagctggtttttggaaaaaaataaaaataaaaaaggtagacttctagttagactaataaggaagaaaagagagaagaatcaaataaacacaatgaaaaatttgaagaggaatatcaccaataattctacagaaatacaaacaaccatcagggaatactataaacacctctatgcacataaactagaaaacctagaggaaatggataaattattgaacacatttctcccctctaagactgaaccataaaggaaatgaattgctgaatagatcaataatgcgttctgaaattgaggcaataataaatatcccaccaaccaacaaaagcccaggtccagatggaatcatagctgaattctactagcggtacaaagaagagctggtatcatttccactgaaactattccaaaaaaattgaaaagaagggatttctcccaaacttatattatgaggtcagcatcaccctgatgccaaaacctgggagggagggagggagggagggagggggagggagagagagagagagagagagagagagagagagagagagaaggaaagaagaaagaaagaaagaaagaaagaaagaaagaaagaaagaaagaaagaaagaaagaaagaaagagagagagagggagagagaaagaaagagagagagagagagagaaagaaagagagaaagaaagaaaagcaaacttcaggctaatatcattgatgaacactgatgcaacaattctcaataccagcaaaccaaatccagtagcatatcaaaaagcttatccaccacaatcaagtttgcttcatccctagcatgcaaggttagtttaacacatgcaaatcaatacatgtgattcatcacataaacagaactaaagacaaaaaccacatgactatctcaatagacaaccaaaaggtatttaataaaattcaacatcccttcatgttaaaaattctcaataaactaggtatcgaaggaacatacctcaaaataataagagccataaattataaacccacatccaaatgggcaaaagctagaagcattccccctgaaaactggcccaagataaggatgccatctctcaccactccttttcaacatagtattggaagttctgaccagggcaatcagggaagagaaagaaataaagggtattcacataggaagagaggaagtcaaattatttttgtattcagatgacatgaacctatatccagaaaacccccattgtctcagcccaaaagctaagacttcaaactatactacaaggttacagtcaccagaaaagcagggtactggtacaagaacagacacatagaccaatgaaacagaatagagaactcagaaataagaccacgcacctacaaccatctgatcttcgacaaacctgaaaaaacaagcaatggggaaaggactgcctatttaatacatagtgctgggatagtcctatgcagaaaattgaaagtggacttcttccttacaatctatacaaaaattaactcaagatggattaaagacttaaatgcaaaaccccaaacaataaaaaccttagaagaaaacctaggtaataagattcaggacataggcatgggcaaaggtttcatgaggaaaatggcaaaagcaactgcaacaaaagcaaaaactgacaaaggggatctaattaaactaaagaacttctgcacagcaaaataaactaccgtcagagtaaataaacagcctacagaatgggagaaaagttttgccatctatccatctgacaatggtccagagtctacaaggaacttaaacaaatttacaagaaaaaaacaaataacctcattaaaaagtgggcaaagcacataaacaaacacttctcaaaagaagacatacatgtgacctaaaacgatatgaaagaaaactcaacatcattgatcatgagagaaatgcacatcaaaaccacaatgagataacatctcacgccagtcagaatggttactattaaaaagtcaaagaacaatagatgctggtgaggttgtggagaaaagggaacacttttacactcttggtgggagtgtaaattagttcaacccttgtggaagacaatgcggagatttctcaaagacttagaggcagaaaaaccatttaagccagcaatcccattactgggtatatacccaaatataaatcattctattataaagatacatgcatgtgtatcattgcaacactatacacaatagcaaagacatggaatcaaccttaatgctcatcaatgatagacaagataaagaaaatgtggtacatttacaccaaggaatactataatgccacaaacacgaacgagtcaaacttcttttcttcataaatcactcagtttcaggtatgtctttatagcagtgtaagaacaggctaataaattttccttttatttttgactgatattcttaattgaaacttttaactttccatttaattatttacatattattgcctttgtaacttttttgttatgctgggataagagatttcaacttcttgccttttgagatattctagtatttgaatatttagatacttactagaaagattcaagctataaagtattagttactaatttagcataaaatctttattttgcaaatactaatacttgcaataacaggtaccagttatgaagctttctgcatgatccaggcattacaataagtgttttgaattgattatcttattcaaaagatctagaaaaactcccttgctatgttgtaaagctttaataaatggtagctattatgacctcacaatggccctaagagtaagtactaatattattcctattttatagatgaaagtgaccttgttgaggcagataaaactttttagtagcaaagcatagatataaatccaagtctgaatgttcattcatccaactcttatcagctatgctcacttgctcctacacttgtacacttttttgaatggtggtttccttttaaggggtgtgtatttgtatgcatacacacacatatataaattcagaatactgaaattgtaaacaatggcacatcataactattatataggaagaattactcaatgttaaatatgtttggctcttgacatgctatattgaaatctgtgcaaaattagtcaaaatacactacacacacacaatcaggttgacaactgtggatcaaggcttttcattgcgttgtctgtctatgtatatgtaaccctttggagtgatcaataagttttaatgggcatggaggaattgcacttctgcagtttaaaacatactgcataatcatagcaacagctttagataataattgatagccatgcttaaaaaccaactccacaggcatggtagcacaaggcacaaaaatctggtaaagatttgcatctctaagcaaaagaaaatatttatatgttgaactttgggagaatccttgggcaaaagatcagatggtcacaaaggaagctgagttactaatcacaaggatgtaaaatgctttatcttatgaagtatagaggacttcccatagctgaatgtagcatacaatgagtgccaaagttcaggacagtagcctggtaactaaaatttactattaattactgtaattaatttattattacaataatttaataataatttaatttatattaataattaatttattactgtaaggtaataaaatttcttgaataagtactgacattgaaatcatgagcaaaattattgtcaaatacttagaaggcatcataagtcatttgtttcttcgaaataaatattatatgataattaagaaggtttattctgtaaaactgtctgtccaatttaatgtattttgttcctcattttaaattgtctttagtacaaattgtatcagaaagaagagatgtatgttgtcttctggattcatattaaatacggaatttgagcaactgtgtgaattaactgcacctgcaaaaattgcaaagcaatgagatttaatttttctgatccatctggccttcctctacataccatctaacactgaagtaatgaaacacattctataattagggatggatattatcaagtataggcttaggaaaaagacttgtatttgtctttatgtgttatttcatttttttgtcaggagataataggcgtatcatacagatgctgagcattttgtctgtatggtattttaatgacatactcagtgaatacagtgtaataatttcataattaagtctcctttgaatagggataggatgttattatcattattttttagctgcctttccagtggcaaaagtaggaatcttcttcactaagtactccagagtttcacataaaagcaaagagaaacatatcaaagacatttagaactcgatggccactatagaaatctgcctagcttacctttcctttaaatttataaataaagaatgagagattccaagagttaactcagactgaatgtattaaattttttagtgcttacattttatattgttacagacaatgcatttacaaggtaaaacctattgcactgatatacaaggcccattctcaaatacctattatagttggagatagcaaaatgatacagttaatttccaaagttatttgagatgtaacttcaaattttcttttttttttttttttttttttttttttttgagacgaagtctcgctctgtcatcccggctggagtgcagtggcatgatctcggctcactgcaacctccacctcccgggttcaagcaattctcctgcctcagcctcccaagtagctgcaattacaagcgcctgccaccatgcctggctactttttttgtatttttagtaaagatggggtttcaccatgttgaccaggctggtttcaaactcctgacctcagatgatttgcctgccttgtcctcccaaagtactgggattacaagtgtgagccaccacactcggtcaacttcaaatttttctaataaaactttaacctgaggaattacccaaaacatgttctcaaatttaagggagttaattctatgaccttaagtaagaaggaaacacaaaataagtaaggtatttttattttaattccagattttaaaaaattattttcttttttaattggcatcaggcttactagtcgtggagagctttcaggaagcaatgaaaaggtcttttaaataaaaagccttagagtatttttaattaaacttactggccaaaaaagaagagaggcaaaccatttgcaactatatcccccttgtacaaagaggtctacaaaatgatgctctgagaatgggtacagccagaacgtgaacataaaatattttatgaagggttaaaatagaggatctttaaagaatgagaattaactcagaaaagaagaacatgtaaagaaattttcatcttggtacattggcatatttctatttgcattttgggtataataaaaagcactggcttatcatttacagctatgttttatattactatttgataggagttttaaatctcccatcaggtgcttgcttcggcagcacacataataaatctctcatcaggatatagatgatatagaaggtacacataattatataataatcattttctctttttgggcatccttgaatgtaggcacaaacatatacagcataaacatgaactgccatgtacaagaagaggcaaattctgagcatatgtattttatcttaaagaggtgctcacagttgagaatgttgcaaaaattgttgttagcaatatagcaaaatattcacaaaatgggaatgagatatttgaaccttaataagtcatacaactttccttattcctgagaaagaagacaatttattctactaaaaatccacaaaactacaaaacctttagactcgcttgaaaaaaaaaatatatatatatatgcttacaccaaagcacctggtatatactacttaatataaattacatattaaatacagtaattacaatttatggcgtaatatgataattacaattagcataccaaattgtaaagcatatgactaatataccctttcaacagcacatgtgatttcagtcaaatgaggaaagtaatgcttcaaatcacatacattatattttaaaatattaattataataaatttcttactatcacatttatttttttaagttccagggtacacgtattggatgtgtaggtttgttatggaggtaaatgtgtgccacggtggtatggtgcacctacagacccattaggtagatattgagcccagcatccgttagctatttttcctgatgctctcctcctctcccagcaacaggccccagtgtgtgttgttctcttccctgtgcccatgtgttcccattgttcagctcctacttataagtgagaacatgcagtgtttggttttctgttcccgcattagtttgctgagaataacagcttccagctacatccatgtctctgcaaaggacatactctcattcctttttatggctgcatactattccatggtgtatatgtatcacattttctttatccagtctatcattgatgggcatttgggttgattctatgtctttgctattgtgaatagtgctgcaattaacatacaaatgcatgtatctttataataggatgatttatattcctttgggtatatatccagtaacggccttgctgggtatttctggttctagttctttgaggaaccaccacactgtcttccacaatggataaactaatttacattcccaccaacagtgtaaaagcattcccatttctctgaaaccatgccagcgtctgttgtatcttgactttttaaaaatcaccattctgtctggcgtgagatggtgtgctgaggctaatatggatgaattgagagaagtaggcttcaaaggtggataataacaaacttccctgagctagaggagaatgttctaacccaatgcaaacaagctaacaaccacgataaaacgtaacaggagcggataaccagaataaccagtttacagaggaacatgaatgacctgatagagctgagaaacgcaatacgacaactccacaatgaaatcacattgtcaatacctgaatagaccaagcagaggaaagaatctcagagcttgaagactatcttgctgaaataagacaggcagaaaagattagagaaaaagaaaagaataaaaatgaatgtacaaaacgtctgacaaatgtgggattatgtaaattctgaagcaaagactgtttggggaacctgaaagagacggggagaacggaaccaagttggaaatcacacttcaggatatcatccaggagaacttctccaatctagaaagccagccaaacattcaaattcaggaaatacaagatactcactgagcagaagccagcccaacattcaaattcagggaatgcaagatactgagcagaccaaccccaacatacgtaatcatacaattctccaggtttaaatgaaagaaaaaatgttaaggacagccagagagaaaggccaggttacctacaaagggaagcccatcagggtaacagcagatctctcagcagaaaccctataagccagtagagattgggggctaatattcaacaccgtgaaagaaaagaatttccaaggcagaatttcatatccagacaaagtaagcttcataagtgaaggaagaataaaatcttttccagacaagcaaatgttgatggaattcgtcactatcgtatttcataattatgatcaagataaaatatatatcgatcagggccaaggcaattagaaaaaactgcacaaattacaagtatgtttataaaaaattacagggaatcatgatcatttgagtttttaaagaagtcaatccagggtatatttgccctcttttctcattgtaagcctccagatagcaagagttattatctctccaacatttagaaaaaaagtattttctatcttcttaggctaccttctaatcaacttaaataccctcagcttgtgtccaggtattattcaagtcaaatctgagtttgaaatgcaagagagcagtcctcctagctgattattttttcacgttttgatctcttgccatgcaactgcttcaaaaggtcaaaaatgcctcaaagctctgacctgaacagcaatcatacgcgcaagcagtgttctttatatgagtacaactgggtgccttgtcatctcaatcacgatttccacaccctgcctcacaataggttttaaccattatgagaactttgctcattctttatactaattatttaaaagaatttttgaaacaattgagtatatcatgtgagtagtcattaatgaaactcatttttctcccacaatcattatagaaaatgtacatacaagtgagctttgttcttcaaagtcacaaccttacagctcatattcttggaattctccttatgtaattttaatcaaggtcaatttaacatggataaaagaaaatcagttgctcttatatgatactatttcgctgttgtctctgtttacctccttttaatttctcttttcctgagtagctccatttctaccttcctgtgagctcaaaaacagccagcaaagatttggatcaatcccatgacagcataatttttggaaaggcaatgagagaaaactgaaacataagcttaagaaaaactcaagcttagtgttctggaaaacaacttacatgatgttaagtccttttatttatttctagcccacaataggagcgtgtaactgtttgaaaataaaattaaaaggagatagtgggccgggcgcggtgacttatgtctgtaatctcagcactttgggaggccgaagtgggaggatcacaaggtcaggagatcgagaccaccctggccaacatggtgaaaccccatctctactaaaattacaaaaaattagtggggtgtcatggtaggcacctgtagtcccagctgctacttgggaggctgaggcaggagaacggtgtgaacccaggaggcagagcttgcagtgagctgagattgtgccactgcactccagcctgggtgacacagtgagactccatctcaaaaaaaaaaaaaaaaaaaaaagcagatagagaaccacaaaaagccctccagacacactgaactacatgacttacatatcaaactcaacctttttcccctcaaatgctttcttgtctatgcctccattttatcttcattgtatccctatgagcaagtgaagagatacatgctgtaatgcatgttggactttatttcataaagaaccatgcaaatcaaaaccagtattcttttattatagaattatacaagttggaagacatcacgtcaattgcctaggtggtggtctcataatttctagggaattaaaaataaggcttcaaatgcttttctaccaattggaataatcaaatcagtaatatttcgatgacatgtacaaacttcatcaaaaagtagtcccattccaagggaatgagcatatttatatagtgtattcccaagaagctctcccttttcacatttcagggagcattgtggaaaaccagaatgttgggattcacacacatatcactgtctattttctttaaacatttattttaggctcaggagtacatatgaaggtttgttacataggtaaatgtgtgtcacaggggtttgcttaccaattatttcatcacccaggtattaagcccagtatccaatagtcttatttactgctcatctacttcctcccaccctcccacctcaagtagatcccagtgtatgttgatcccctctatggtctgcagattgtatcaaaggcttagtaaagatgtagatttttaggtccttatcacagcttatggatgagattttctgagcaaaatgtttaggaatatgcattttaattagctcctcaggtggctactatgcagactcaagtttgagaaccactccatgcaatgcaaatgaactagaagatgacctacagttaactgttacagctccctaaacatgtcccttaaaagggatgcacgtcaaaataactttctttatcaaataatggcaatctttcttaacacggcaactgaccattttatggcagcaataatctgtggaagcaatgggtacatatgggaatactctcagtgttgggttaaaaagtatcaaattgactaatgtctcatgtatttattacataaataccaatgtattgcaaagaagccatgggcagatcacataaaacaggaggaatcataatatagtactaaaactactattaggtcaattaattgctaaagtatgtttaatggaaaacaaatggagtttttattatgtaatgattgtgtgggaaattattacaatttatattcatatttcttcaaattataattttttaacgtaaaattggattaaaagtaacattgaactgtgattgaaaatcatataggctggtttattacgctgtcttaaattgtattcctggaggcaatactacaaacttcatgtctccaaaaggcatttcctaagtgctacttatcagatgtcaggtctcaagaaaacaaattccatgtacttgtctcaatatagaggaaatatttgcctaaaatctattgaatatggaagtgtatgcctgtgcattgagctatgaattttgagtaaagttattccttataatgccaggctatgtggcagaatatgttaaatactattatatataatgtttatatcttgaatgactactcattattctaccatccaactacataagacaaaaagaggttcaacttttaacgataccccattttagtgactaaatctttaaaaattattataataaaaccacataccccaaatgtagctgagatgttttcataatctacagcccgtatgtgttagtataactaagccacattcataattttatgaaatcagcagtctatggcagaaaaggtacaatagtcagataattaactacactaataaaaaactttccaagaaatcaaaagacctgaaccctagttctcctaccactaacttctcttgaaaaatttacttttcttccctaagtttcatttttctcaagagtaaaacggagttggctaatgttcctcgtggttctagcaatctctgatttggggttagactgtgattatacagttcccagcattttgttcgcctgctctaagtcactcagttccccgttactattgggctggaagaaattcactctagggcagtaacaagttcagttaattagcactctacctcaccaccattctccaacaacaagacaggcaaaagaatcatgtttttatttaactaaacacagggcaaaaactaatctggttgcttcttttgtagggttataatgtcactctcttaatgcaggtttaaaaaatctctgagatagtctgtagcatgataattggtatcactaacctgtgctgtactcttttcaagtttttggactaaattatcccaacaccgggcaaagttatccagccatgcttccgtcttctgggtcactgacttattcttcagtgttgaaagaagatcttgtttgagtgaatacagtttgcccatggattgctttttcttttctagatccgcttttaaaacctgttaaaacaagaaagatcacagaataagcctgggttgcattccatacaccactatagttcaatctgcttttgcgtgtatttgctcatttgcatagataagaaaatatttcaatcgtgcccgcaaaggatcaaaagttcagaaaaatagaggtagaaagttataatctatctaattatcccaagaagtttgaagagaaaagaagagaaaagaaactcaaacgtagaataaagacctactagaggtaattaagagctaccttgaaatatttgaagaaaatccaagtgaaaaggtaatattgcttcaaaaggcaaaacagagatcaacatgtggaaattagaaggcacggatcttggatttccccttaattcctgacggaattcaaacgaaaactgacaatcaggtaccaggagtactgaagaaaagctagtgagctgagaaaatgagaatggctaaggaaacttgccattctgaaatgctgtgattatttggataaaattacaatattattgtttccacagttttaacattcggttcattatttggagataaaatctcattatgtgatttactgaccataaaatttttgtagcatccattaatcaattaacatctggttatttgagtaattattttttaaaactaattgtagagcccattaagtaaaagaactaagtcgctgggcatgacataaatgcttcagcatctcttttcagagtttataaatacttatgtgtcttatgaagcaatttttataccatttatatttccaaagttcctgtgagctgtggagggttacaaactccctttggttgatttgaaaggaataagtggtttatgtgaaatcagtaaatcagggcagtttttcttttacttgactcagtaactttgcctgatacacagacaaattcaattcctgggtactgaacattactccctgacttaatctgtaaacaaaggagaagaaggaagagaaataaaggagaaaattatcttacagccacttaacaaccccatatttggcagcaaatacaatgaatgtaaactaaatcgcgatacctgtctttccgaaacaaatgtaagtttatttaagaactaacataccacagagcaaattgtcatgacacaaatgcaccaattgcccatgaagcaaagtgccccaaacctagagcagtcaatacaccttcctgaaaaggacaatctaagtagcccattttggcatggcacctgcattgatagctctgaactgcagaatgctctagtggctccttcaattagtttgtcttttactcagaatctgcttcacctggagtatgttatagttcagtcttcatgccatttttaaggggaaacaaagcaagatttaagtttcatctctaatttttccttaacaataagttcagtatttttctaagtttgaaagaatgcaatagaccaaaatacaaattaagatattatacactgaattcaaatcaaaataaaactcacggtgtgggggtttagcaataggtaggtggtttttcttttttgttttgagttggagtctaactctgtcgcccaggctggagtgcagtggcatgatctctgctcactgcagcctctgtctcccaggttcaagcaattctcctgtcagcctcacgagtagctggtattataggcacatgccactaagcccagctaatttttaaatttttagaagagacaggagtctcaacatgttggcctggctggtctcaatctcctgacctcaagtgatccacccgccttggcctcccaaagtgctgggattacaggcatgagccaccatacccagcccaatagataggttttgcatattcattttgtttaattcacttgttagttttccattaaatttaagtgaatatttgcattagtactagaacaaaggttgatgctacctgtcccaagctgagagccatatttgaatttcaatgtatattcctccagttatagtgtcattttttttctttactatggaaagaggcacaatatacacaaagacacaaatctaaaaataaaaaaaaaatctaagtacaatcctctttgacttacttactcagaatgttagaaactattttaaatagccatatgtgtaaggctgaatggtctacccattatttaaacaaaatatgtaatgatttggaaacatgtcagaagaggagtgtgagaattatgtttaaagaagaggattgcaataaaaacctatgagtaacctcatggtacctaaacaaatgaaaataagcctcctgttttattattaagccacatgaagaaacatttggtaagcattacaaaaatgaaagtgaaagtcaccattaaaaataaaattagaggtggtggctcacgcctataatctcagcactttgggaggctgaggcgggcggatcacgaggtcaggagttccagatcagcctggccaacatagtgaaacctcgtctgtactaaaaatacaataattagctgggaatgttggtgcatgcctgtggtcccagcgactcaggaagctgaggcaaggaatcgctggaaccagggaggcagaggttgccctgagccgagatcacaccactgcactccagcctgggcaacagagcaagactccatctcaagaaaaaaaaaaaaatccaattaggaaaaaagtgcactcaaggtaaagtaaaatcaatgttataattacattgtgtgattattgaataaatgaatttttatatgtctgtatgacaaaaacactgaacccagacttatacctagtaaattttagatatgagtatcaaaaatgatgatggcagattagttgtttggtctcagtttctctctctttttctgtctttcagtagtcatctcccagttccagaactcccccaggattattaactgagggaggaaaagaaagaaaatccatgatggggccagatacattagatcatagaattcattagaattaccttgtcctgtctatccattgatgctgattcttttaagcttaggtcttacatgtgcatattaaataactatgatttgttactaattattgcataaaatatgtatttctacatatcaataattaaccataggtctatgagtgccagagacccatagagctctagaaaattcaggtggcaaaaggaagatctagagaatgtgtacaaggcaaaggccagctgggatagtaaaagaataaacagactttatttttatagaagccaggaatgtagacctacctccaaggtagggaggaaggtacagtcaataaatcagactgggtcagtagtggatatggagaagagacagataagctgttcaagatgatttgaagtgaaaagataatgtatccttacaaaaggcccaggaaaccttcacctcactctcatcaggaatacgcataagagaataatgccaagacaatttctcctatattggcaaaattgagttttccacctatattatgtgtagttacttatctacatgtaagatgtgctccaattcattctaatcaccagttgtactttgggaggttgatctattacagaggttctcatcttgaaagaacatcagaattacctgaaaggcttgttagaatgcagatgactaggctccacttccagagtttctaaatcagtaggtctgaagatggcctaacaatgtgcattcctaacaaatttccttgatactgatgctgccggtcgggggaacacattttgagaagcattgatcctgtctgaattaattatttgagggccatcccaggagttgaggtaaaggtagcaagtcaaacaggaacttgctcagttaccatgagcacttcatccatgtcctttgatcccacagccatttgagaatatcttcaattcctaagtacttctgtagcccttatataccataatctcttggatcaccctgcttccccagagctgtccttccccagcaaacgccaacagtccccacagcagaaatacatttactcaggaacaggtttcttcttgacttggatcttcccacgataatttacgtgattctacaagtcttataattcacctcataaaagctactgtttcttctttcccttcatttttatccctgatgccaaatcagtttaaaacttaaatcagttttgattataaaaaataatagatctacatgatttggatatgaatcccaaagatctagagcaaattaaatgtcataatccccacctcccacctcaatggcaagcaggacacaatcccatgggttatcagtgatactattttgaaacaaattacacttattgtaaagagaagagagtttagcacagtgtatctatacctagacatgtagtgaaaactggtgacagatggtacctgttttgggtctcagattgtgacatattttaatgaacattaaattcttattcactgcctgagtcagcaaaggaattttacctcaaattctagaccagctgtcaggttttgttaattggcttaaactatcaaatgacaagacctatagaaaacatattttctctttgttcacaagcaaggtgacataacacaaattttaatcctattggaaaattattgactttcttaaaagagcatttttatggccctgaggctagccaagatttctgctcacaaaaatgttaacatagaggcacattattgttagaaatgacagttctcagttgcagttattttttccaaggaatcaactgatatgaggactactgaaatagattgaaaggcctggacctgagtctggatgtcttagtgttcattttaagtctgatactaatgttgtaggatacagatcctgtgttttttcttgatctcgattttctcttggaaacaaactgagtagatggtcctaatgaactttacatgtgtaatgagattgaagaaacactagatgagatgcaaaatctcatctagctttaacatatttggattttgtcagtttgtggcttcctaagaacaactttcttgattggtaaatctagtcaacaatatatgcaggaactttgactagatattaagatttggaatttatcatcatgtaaaataactgtactattctggcatgtggtactttccaaagatggctgtaaaatatcctcatctcagatgctttgctataacttgaccttggtgtttctccatgaggaaatgaaatctaattcccttttccttgaatctgggcaggcttgtgactttttcagcacacagaatatgactgaccatcaccattatgattgaccgtctgaagcacatgattctgtatttaactagcaatatatcttcgctcctaatcagagggcatgactgcattttgataatcagtggtcactcacttatttactgaaaggattcacattttgcctgagaagaacaatgtttgtaaggaatattctgctttaaggagatgtaatccatgcatccattcctctagatatgatagaatccctcatgaatttatcctctcctctctgtggcatgtgacagtgtgtaccacttcctacttttttgaaatctttattctcctcacttttgtgataccactttccccttgtggtatctgctcaatcttttggtcaacatcttatcctctgcctactccttgattgtagacattcctccctgaaatctattcgtttcacttaatgtgtcactctacacaatccctcagaagcattttgattgcttctgaatcaataactagtcatgaaccattttctgagattctagttgtgtaaaccaactgattaatggaaaggatttttaacttggatgtctcaaagacattttacacggaatatatccaaatctgaaataattatcatttttgtcattccagcaattcctcttctattctcctgttagggctaataaccctcctaggaacccagtcacccaaatgaaatgtctaggaaccatttcaaacttctgcctcttatcacaagtttcattcatcacatcttaacattctaatgtttctcttcttatcttaatgcccaatgctacttagttcaggtcttctgattagtcctcgtaccatcaaacatcttcctaccaaaaagaattacaaaaatgcaaatatgattcttttgcaaactctcaatggctccccatcagctgcaggccaaaactacaaatacagctgatatttttgcactcgtgttttcaaacatatacaggttacttttctgaactctattttcggcagtcacatcacttaataaagtccatattctttgagcaataatttcttatcaataataagctagcttgtaataacaagtaatacataagtgaatctattttaaattaaaagaccaatgagggttagcatttatggagcaaaaaaaatgtatgaaacaaataaatagctggtaaaatggtacgtatttaaaatgagtggaaaaatttacttaagtttagaaattattgcattattatgaagtacaatgcaataataaaggtgaaattatggaacactacttacaaccattttgttttataaaagttcatatcaaatgaacatttaatcaaatctatcaaaaattttaagaaatcataaagtagaatatgtcacgtgaaaaattaaactcatagtatcagaccggcctcttttactagaaatgataaaattcacagagtaagagaaactttagagtttttttttttttttttaaatcttggaaattcctgctgaaaccaaatgcttcaatgaagtcttttctgaaatccatttattgccaaagaaatctcattctcaaaacactcgaggtatttataatcaatgtcatttgataggctttaatttttttttgcttgaaaaactaggtgatattgtttggatctctgttctccaaatctcatgttgaaatgtgattcccagcattggaggtagggcctggtgggaggtgattggctcatgagggcggatgtctcatgaatggcttagcacaatccctttcatgatgagtcagttcccattcagttagttcacatgaaatctggttgtttaaaagagtctgggaccttcctcttatctcttttgtttccactcttgcaatgtgatatacactggctccccttctccttctgccatgattgtaagcttcctgaggcacttaccaggagcagatgctggtgtcatgcttcttgtacagcctgcagaaccatgagccagttaaacctctttatttcataagttacccagtcccagtctcaggtacccctttataataaactaaggttaaactccatcaatgtcaggataaccgtcgcttgtaactctcacatattattctgagaatcaacgtcagtctatttttttagaactatgctgcttagaactttatgaaaggctcacagacatttcttagtattactttattaattttaattgaagtcttattctggtatgctatgttttatcaagagtacaactttgaaaaacaaagttgaaaatccacctatagttttttcccactttaattcagaaaagtagcaatataacatctttgaataatctatgatccaagcaaaaataaacatttaatattcaatagcatagaagagactaaataatagtgataatatacagtactgggtttttataagaccattgaaagctagaaagtacatacggccagtttttgaagacttgataacatttcattttgatctttaaagccagttgtgtgaatcttgttcactgcatcttctttttctgaaagccatgcactaaaaaggcactgcaagacattaaagaattccaaggaataaataaacataaatctttacttttccaatttaatatccccccgtgtcttttacagctagtttctcacacatgacacacctgttcttcagtaagacgttgccatttgagaaggatgtcttgtaaaagaacccagcggtcttctgtccatctacagatgtttgcccatcgatctcccaatacctggagaagagacaatcaagcacagcatcagcaaacaattggtaactacgttttattaaaaatggcatgaataatttgccaaagtatctcagtctcctatgtacgctagaagttggaagggacactctttctgatctgcttacatttaaataagtggtgtgactgtcatttgtctttatctcaccaagtcttgtacctttcatagaaaagcaaagagacaagcaatatgaagtggttattataccactatataaaatggctccatagcaaatgtaagataacaaagacatacatatagagaggattttgcagtgagaacaagtaaaaggtgtattttccttaggtttgaaaatacaccctaaagaataaaagtctaactactaaatagaatgcctcaaaagactcttaattgaaacaatcttgcataatgagaattgcctaccatttggattgtagaagaaaattcttagtaacttaaattctattactatgtagatttttcaattttctcaattattacaaaagtattaaaattttctgtttctaaactactctagtgagaaaactaacaatctctgagtaaaaactactatatcattaacatgtcactaatgtctaagaacacacactattttaatatgtaacataaaccaactatcaatgatttttggaaggaaaacaaatattgtgatgctttctatgcaaaggaagcatttcaaaatggcagttagctcaacctcattatgatgcactttatagcctgaattttcaactttttgtaactttttcatataaataagaaacttattttctcatatatatattggacctttaaagctagaaatcataaaatattgacgtgctttattttatatagaattagagttagaaaaatgtttataactcatatttttgaaaaatctactcagtgtctaaggtctcataatttctatgttactttatactacatatgtgtattaacccacctagaggatattaacacatgatttaaacaatgcaaatgaaattagcatcatgaaaataatccacctattttttttttttttgtagacagagttttgctcctgtcacccaggctggagtgcaatggcactatctcagctcactgcaacctccacctcctggattcagggaattctcctgcctcagcctccccagtagctgagattacaggcatccaccaccatgtctggctaatttttgtatttttagtagacacggggtttcgccatcttggccaggctgctctcgaactcctgacctcaggtgatccacctgcctcagcctcccaaagtgatgggattacaggcatgagccactgcacctggccctaatccacctatttctaagtgactaggagagtcacgtttcttaaattgtttaatctatcaccacttaaaaaaaaatacacgcatgggtaaacagaaggcagtcaacattttcctacagtattaacataatcatgtacttatatgcagctcaatcataagtgagttttcagtttttcttcataaatatcaatgttattgctttcagcataatgtaactgttaattttttgtagtttcactttctactcaacttattttgaattatgtttacaataaaagccatagcgctcaaacagtgatgcgagatacccacaggaaatgtgcgagcttaaatcaatgaatttagtcacttcaaccatctaattattacgaagcagtatatataggttttttctaaaacatacttgcatttttttagctaacttcctagtgaccctgtcagtgcatgtcaggtaaaatggcacgtaacaaaatggttaatagattagttgtgggagaaaaaagcttcaaatggagaaaatcttatctcttaagtataaactacaccatctacctgacgtgatgatgcagatctacaaagtcaaaatgtgggaaatttattgtagcccatcaactccagtgaagaagacagtcaagggaagaagggacaaactcaagctatagcatcatattcataaacaaaaaagactttcaagtatatatagcatcttctctctagtgctacaagacatatagtatccactgaagcagcattttaagcttgtaaccccataggtggaaatgtataatttattaattttagtgggaatacaaatccaaataaagatcccctattccaggttgtataacattttcaaatttattgaaattctgagatgtactaatgggatgcatttaatattgcagttttgttcactgtatgagtcacaaaaaactaatagagtagttctcctttatccataggggatatgcttcaaaatcctcaggtggatgcctaaaactgcaggtagtacaaaaccctatatatagtatttatgaatttatttttctttcttcgcaatttcacggatagacttgctcttaccacagattttgagcaaccccagcatgcgatttttttcttgccttattaagttgggaaccttttcacataaagaaaacccttcacagtttttctttggcatatttgaactgccaccataactactcttgcactttggggccatgactaagtaaaactagggtgacttgaacacaagcactgcgataccatgacagtgtttctaagaacctagacaggtactgagtaatgggcgggtaacattgacagcatgaagacgctggacaaaggggtgattcagtcctgggtgagacagaggtgggatagcacaagatttcattatgctactcaaaacagcatgcaatttaaaatttatgaattgtttatttctggaatttttcatttaatattttctgactgtggttgactgccagtaattgaagccaaggagagcaaaaccatggatgagggagggagggagggagggagggagggattgctgtaattaaacactcttttaggtacataggcaacctatttaacataactatttaaaaaatgccacttaaagtgttctttatatccaaataatggagcaagtttatgattcagctaatatctaggttacagttaatgacagccatcaatgcattcattcattgatcatgaatttattatataacaaatatgtaccaaatatctggatatgccaaatattaagagaagatgttacaggctcaattgtgtcccatgaaatccatgttgaagccctatgccccacctactacatcggaatgtgcccatatttggagatagagcctataaatagaccattaagttacaatgagtctattagggttactctagtccaatatgatgggtatccttatgagaagaggaaatttggacacagcaaaacaccagggatatgtgcaacacagaggagagaccacgtgaggatacaggaacaaggcattcatctgcaatccaaggagagaggcctcacaagagaccaatccttgccagtaccttggtcttgaacttctggcccccagaatggtgagaaagtgtttgtattgtttaagccaccagtccatgttattttttaatgatagccctcacaaaggagtaatacaaaagacaattaagatagatggattctttttcaagaaatacttggctaaatgtctgtcgaataataataccaacccgttaaagaattgcaaatgttaaacaagagtatgtatgggaaagtattattaatttgaaacaagttatttaagagttggtcgttgtttacaatttgcttgatcatggttcttacatcaaatctaagaactgccaagggtcatctattttactgtattcactgtagaaaggcacccattaaatctttacgaataaatgtttagtcttcaagtatattctttaaaggtttccaacacaagacagcatgaacacatatcctttagtaacatattctattgcttaaacctatcttactcttagaaaatactcaatgaattgaatctaagtcacttctgtagcaaggcaggcatagtgctttccactgatctcagtgtaagcggaaaagtgaattagaaattacttgctcatacgctgtaaacatctgcccatacatttttgtgatgccatatgcacaagtataaatagataatacacgaagtgctttaaatttatggatttacctatttattgcttagcaatattggccttaatttgaattacaaagaatgaagcaaagcaattggaagactatatccctcagctctggaatcactcaaagatgctggttcctatcattgcctgaatggctataacaaaattgttagacaagtgtaagaaattggataaaatggggctaatacatatattttttaaagaaccactgtattaggattagaaacctcttctctagagaaaaaaaaaatatgtaacttcaactctgtttctctgagtttctatttacgtataggaatcccttgagcttttagcaataatgcatatttttatagagctaaacattctacacataaatgtaaaaccaatgaattacaaagtctcacaaaatggtaaaagaagttaatttttatttatattctcattttgtctcagcagtaagtgaagctaaaggtcagctcacttcgtctaacattttcatggactaaatcacaactccattatcgtccatgctcagatccacaacggggaggattttttcctcccatttaattcacatgtcatattgttgtacgtgccaaggacatttctcatctgaattcctttgtttggttgagttgctatttcaattcaaaagtgaaaaatggctactaaaagaacatttggataaaggtaactgaggaaaatctgacaagcctgggaggtaaatcttaagtatggtgacccttgaatttactggagccagggatagaatatgaaacctaaactgtgcccatcagtattggcgttaagagatagagtgttcccaggcgtatatccactaaggcggaaacaattatgtgccatggaccacacaatgcatcagcaacggggctttatgaaagagggaggcagaaaacaacccatcttattttattgcaggttaagaccctataatacacttctctgctaaatgaattttatgtgtaatgagccctctgaaaatcccttatttcttgatttttctcttactttatcaacaactatgcagttaaaacgtataagcaacttactcttactgatgttgaaatggaaatcacatcaaaaaccattgaaaaaaacaaaaatccattatgaggcagaaatgtggcagagtcctactgaatagtgtttagccaagggtatggcttggttctcagttttacacatttctacaaactgaactgaagcaccatactataaaatggtgtaccttatatcttcactgtataacatatggtacagggcggataaacctattttgatgagttatgaaacaactactggaagttttttcaaaagtataattcttacttctatttaaatgatcctgtaataatctcctgtctgaactcaaggaatttttagctgtcacttccaaaggggcaggttacagatgaggaaactgacagataggttaagtaacttgtctgaggtcacagaagccacagtactgagtgtctgggatttgacctcagatccatttggctacaagttcatgctcgttcataatggtattcattcagtagggcattcattataaaagatatgccttctaatttgtgctacacaacctacagtgagatatccagatgccgaatccctttggagtcttttcatattttgttttagcagaagtttgactagatttaacatttaatctaatctgcttcacaaggatgtgaagcttaatgttataatttgattcaaaaacatttgacactgtaactctgtatttgtttaatcataaaacgtcagcaaatacttgcacttccagattaagaacatgtggcctttgcaggacttatttttaaaaggtaagtatgactgatttgttcattaaattctgcctttgcaattgtgctgaaagtgtagtgagattttaacacgaagaagcatgttcttctctacgctatttcagtcagtttcctatattatttatttgtgtgagtatacaaagtgctaatgaataaatctggaaaagccttttgttgttgtcactgctgttattctttgcaggatattatttaatgtcttttttttttttttttggcagcttaataaactctgtactctccagctcccaccagtctgttcaattgggataccagaaaataaagagcaggagttctaaggagcattccagcgtaacagtgttccttccagcattcatcacattcccaggcattccttggtagcttgaggtttcctcttccttatcgttttatacctcgcagactctgagctccttgaggtgggctccttacctttgaggttaatgtcttgcacaaatatcccaaaactgaatactactactgtcgttatcaataggtggctttccccacccaacttttgtcttagaaccatcttttttggatctttcaatctgctaatcattacataaagtataaacttcctgcattcccacttcagttctactgttgcccaactttgtaatatctgtgaacaaactcaatcttgctgtgctttagttttctcaccagtgaaatagagataatagtacagactctcctagacaggtaactgctagggtcagatagatcaataaatgtgaaagtgctcttaaatctgtgatgaattattgagatgcttgtgatagtaaggatttagagctcagtcgataaaaaaatcagcctttattccagatgtgataaatctggagcatgatagaattttaatatagaacacagtgaaacattttagaaggacaattaatgataattttttttgcatttttttctatacttgataaagcttatgttttatacaagaattgaaaatttttacctttacaattttaaacaacagggccatattccaataggtatcctttttttctttttctttgagacagagtctttctctgtcccctaggctggagagcagtggcgcgatctcggctcactgcaacctccaccacccaagttcaagggattcttgtgcctcagtttcccaagtagctgggattacaggtgtgagacaccacacctggctcttttttgtattttagtagagatggggtttcaccatgttggctggtctcatctcaaactcctgacctcaagtgatctgcccgcctcggcctcgcaaagtgctgggattgcaggcgtgagccactgagcacgggctccaaaaggtatcttatttgaaagcaagtgcatagaagataaatatccctctatgtctcatgccaactcttgacatcacaacttttcatccacaagaaatcacaaattctaacgtacatacctaataaaatgcataagataatgtaggtgtaacagaataggtagtaatggggactgtggctaaatgaagagcctgtgctagagaaaacagggcaacttgactcctgctctggttactatgtagaaaaacagactaaggatcatcagatcatttgctttctctagagaggttagaaattcttagttcatgtcacatttttttcaatttcaaacaatggtagctaataaactactattaaataccatagggactaaatagaactttatctaaatacatctgtaattttagatgcaatagaccaattcctagaaagacacaaatgattcgagctgactccaaaacggaaaatctggaaaaatgtaatgttgaaattccaattaaaaatggacatttttatgtgtattaaatacataaaaatttaattttaaaatttcccatttgcaaattccagttatgaagccagttaccaagcctgcataatcaggtacttaaacctagcaagcatattacaagaaaggaaaataacaggccaatcactttcatggacgtaaaggaaaaactatgaatcaaagaaaatctagcaatacacaaaaaagattatacgtcttatccaggtttagtttattacaggaagaaaggcttttttagcattagaaaactaagtcatgtgatttgacatatagcagaataaagaagaaaaatacgaccatctcaaatgattctggaaaaatatatgataaaatttggcatccggtagtgataaaacctcttagaatattaagaacagaaggtatctacaacaaacctacaggaaagatcatacttaatgattatttattaaagttcttccctctgagacttaaaatgagaaataaatatccacaatactcccattgtactagagtatttatacagtacaatatgtcagggaaaattaatgacatgaaaaataattggaaagggagaaagaaaactgtcattactcaaaaacaacctatatatgtacatctgaataatactacagataatgtattcaaattattaagtaaatgtagcatggtacctggatacaagaccaagaaaaaaaatcaactgtatttctttatatcagcacaaatagaaaatgaaatttcaaaaatatattcataacagcaaaaatataaaaacccaagaaataaatctcagagaaagtttaagagcctttactttaaaaactataaaacattattgagagaaaataaagacctaactaaatgaaaggattgaaagactttacataataaaaatgttgattctgtacaagttgatccagagaatagatgaaatccaattaaaaccacagcagattctttttgggggcagggttcacaagctgttcttaaaattcatatggagatcgaaatggccaaaagcagtcaagataatctttaaaaaggaagaaaataaaatggcttttactgaccaactgaccaaaacaaacttaatgtgactaaactctagacaggcttttatttgactataggctcctgacctctcttttcttagagcgcttactttagggaaacttgcaaccaaaaacatattctctgcctctttgagatgtaaatcttctacaatccgggaatatctttctcaaggacctaggagccatctctttgaaatgtaattgttaatgatagcacgcctatctcccagtctctgtgggacagtaggagcctaacttcattaagtgccaattaacaatcacagattgcctaatcaccatcctaaccccctaatatcttccagtatttttctactagctctcctcagtgcttaaattctctcctgtctttctttcagtagaaatgatttccatctctctctcctatggcaatagtcttgatccataattcagtagtcttgaataaagtctttcttgcctgtttgtctggtgcattttttcttttacaatattaccagatacaggctgggcctggtagctcacgcctgcaatcccaacacttcggcaggccgaggctggcagatcacctgaggtcaggagttcaagaccaacctgaccaacatggtgaaaccctgtctctactcaaaatacaaaaaaaattagccaggcatgatggtgggcacctgcaaacccagctattcaggaggttgaggcaggagaattgcttgaaccagggaggcggatgttgcattgagctgagatcttgccactgcactccagcctgggtagaaacagcgaaactccatctcaaaaaaatattaccatatattaaaacttgtcataatgctatagtaattaaaacaatgtggaattagcatgaggacaggcaagtagagaaataaaactgattagagtccataaactgatccatgcacgtataggcattttatttctaatattttcgtcaaagatgacaccacagaatattgaggaaaggatggtcttattgaaaatctttgcaataagaccatcttttcctcaatattctacagtgccaacttgttgtttcagttggatctatatgggaaaaaatggacattcatcccttcctcatacctgtaataataggtggattgtaatacgaaaggtaaaacaaacagttcctatatagcaacccaggaccatagcttcagaattttaaagtagagagttttatttttaaactgaggacaaaagtacactaaacataacagaaaatattgaagtgaactatgttaaatttaaacttctgtttatgaagagatatatcattacggagtgaaaaggcaaggtacccattcaaaaagaaaaatgtaatataaacagcaaagaatacccagaatatatatattttaaactaaaataaatcagtaagagaaatatagaaaatccagtagaaaaacaggcatttcagagaagagttcatttaaatggccaataacaactgaaatagtattccgcctcactggtcatcagtatatacaaatgaaaaatgagagatgacattataaagtcaccagaaaggctcaaattaaaaagtttaacaaacaagtattcaagaagatatgaagcagtttgtactttcatttactactggtgagaatatgaatttatacaactttggaaaaccctttgttaatatcttgaaagctaaatatgcatatacccaatgattaagaaatgctattcttaggtaaatacctaatacaaaagtttacatatatacacaaaaatatacgtacaatttatgttgatagatgaattatttgtaatgcttccgaactggaaacaaccccaattttctgaacagaatatgtaaaatgtggtatattcatacaaagtaattctatccagcgatgaaaattaataaagtaatgctatatgcaacatagtgaatctcacaaatatagtatccagtgaaaaaagccagttaaaaaactgcatatataaaagtttcatttacatcaagttaaaaatatagcaagactaacctgcagcattataactcaagatacatgttacctttgaggagatgggaagagtttatgataccatagggcttgatggaggtttcctggttgctggtaacatactatctttttctggatgtggaatcatagtatgttacttctgtaataagtctttaagctataattataacttatgtcctttgcttgatacttcaatttaaaaagtaccataaagtttgcatttttttttcagaaccatcaacagataaacagataacaggttatatatacataatgcaatgttatttggccataaaaaggaatgaaatatagctatttgcaacaacataaatggaactggaggtcattatgttaaataagcaggcacagaaagacaaataccacatgttctcattcacatgtgggagctaaaaaattggatctcatagagctagagattagaatgatagatactggagactgggaagagtgtgtggatggaatgaagagaggttgtttaatgggtacatacgcttagatagaaggaataagttctaatgttcgatagcagagtaggaagactatataattatatacaacagtgtaacaaaatatcacatgtactctataagtatgtacaaatattatgtatcaataaacttaaaaattttttgtaaatgtattaacacttgcattcataaagaatattattggccgggtggccgggcgtggtggctcacgcctgtaatcccagcactttgggaggccgaggctggcggatcacgaggtcaggagatcaagaccaacctggctaacacagtgaaacccatctctacagaaaatacaaaaaattagccaggcgtggtggcaggcgcctgcagtcccagctactcgggagtctgaggtaggagaatggcatgaacccgggaggcagagcttacagtgagccgagatcgcgccactgcactccagcctgggtgacagagcaggactccgtctcaaaaaaaaaaaaaaaaaaaaaaaaaaaaaaagaatattattgttccagcatacttgcttatatttcccctgtaattttgtatggtgggtattatgatcactgttatctttgagtttcatttgataatttttatcatgagagaatttattgttcaactcataaattataaagtcagaatagaaaacagattgagtaatccagacattgtgttctttcaaatctacctaacaccctattggccaaatgtattacaacagaccgtgtattaacataaattgaaatctagcgttaactgtatacttacagcacattggctttggatgttcaaatttcattagaatattcaacatttatttatacttgatacaatgtgcagttgaaaaaacaatgcacatatcaaagctgatcaaaacatactcaaaagttttctaataactgaatcatgtgccattttatatttaagtaaataaaataaaaaatccagttcctcaagcataccagtcacaattcaagtgctcaaaatagccaaaggtgtatagcaacttccttactgaacagtgtcgttctagaaaagaaaaaaattttatatactaatgcaatcgagtgtgacaggtgttaatatatatatactgcttatataaactatatacatatataaaccattctcttctagaacagtgttgttctagaagagaaaaatatttatgtactaatgcaattgagtgggacaggtgctaaaataaataaatatatatgtttatattatatatatttgtacttgtaaatttaactcattcatgcaaatgctatatctattcatatatatatgaatagatattgcattttatacagatagatagtatttgcatgaatgagttaaatttacaggtacgaatacattactgtgttacataggtttctgtattcccccgttgctgattagtaaaccaaaactgaaaaaaatcacataattttcacaaggccacatagcaaatttctactatgaatttgagagattgggagaaatctcaggttgagttgtcacacatctgaataccagtgtcagccttgccacctgcaagctatatgaacttggatttaacttcattatgcattggctttctcatttgtgatatagggttggcattacatacaaagcatgtaaaactcctgaaaaataataatctaataattataattattgcttcttgggcaacaaatgttgatgcttagctttgtggattatttccatcacatttaaagttttttttaaatgcatttaattcaccaaatataaaattaggaactagagcgaaacatcaaaatgtttcaaccatattcctcttcataaataacttctatttcttaatttgatagggtctaacattctataaaattttctttctcatactatcccgaagatatgtactataaaaatttcagttacctaactgacatttaggtgatgagagaaaaatctgactttatcgtctttctgaacaactacctttcacagtatagcattttctttccaagtggctttgttattttaacattctctttgtaactgagatatagcacattccctttgtaacctgtgtgatactcatgttacacaagttaaaactattaacgacactaacagcaatgtccaaagagatgttaccattaaatgtctgtcattcttattgtctacttatccagatttgtcacctttaaaaattatcactgttggtcaaaataattggcagaatgtagtatttgacttctttatattttgccattatattcagattgttttttcttatgaaagtaattttgagaatcatgctttttaaagctgaagttctctacagaatgagggagaattatgcttctactagataagattgggcagtatttccttttattttcttgcactccacctgtattggaagggacattggaggctatcaagtctaacttcccactcagtatgtcacctcttttaaaacatacttgaacatgagattccagtttgtgttaaatattattaatgaagaacagctcaccactttccacagctcttatcgcattgtaagaatgctctgggctgatgatgataataatagtaactaatattattattgcttactatatttcagtgatttttaaatgctttagcttctcaactacccttttaccctttacagatatctgataatgtaggttctaatacaatcttcatattaaagatggggaaactaaagccaaggatggttaagtgacttgcccaaaggtatactgtagataaggaacagagcaggaagggtctatttctagagtttctcctcttaattaccttacaacaaaaagctctcccttttaagtcaaaaaaatctttcttggaattatatccaaccgtctgttcataggttcattcagttatcttacaagaattactgattacttgtatctgacaatgcaggcaagaatgtgtaagacacatctcatgtaatttagattctaataaaagagtaaagcacattaatattaactgcaaaagtatatgatcggtgcccaaacagacacaattagggtacagacatggcacaaagagggagtagtcatcactaggtagagtggccaatttcatggaggaaaacttgaaatgagttttctatacatagatgaaattatcaaagcagatcttatgaagcagagtcgtctgtttaaacccggtggtatgtgcaaagaggtcgtaacatacagggtatcagaaacagcttgtatgaatcaaatgcaggttgagggacataaagcagataacatgagacaagtctatagagactggtaggagtcaggtaatcaaataccttgtaggccaaagtatcagaatctggaaagtgactcaggattttaagcaaaggagaacgattaaacaggctcttgggaacccacactgacttcaatgtggagattggatggaagagcggtaagactgaaggcaaggactttgggggcttatgatatggcctataccttgagaaatgttgacaagaacaaagatgaaataataaatacaagataaggttgagaaatattttgacattgcatgcaaagggctcataagggaaaggacagggatgaatttggggatgactctaggtttctggtacaggtgtcatgataagtgccagtgcaatgacaaaaataagaaattcagtaaggaaagcaggtttaaaggaaggcaatgtacagtgaggtaagtttcatcttgttgagtttgaagtgttgtttggacttcaaggatgtgttcagaagataattagaagaaaatggactcaggaaagatctgggcagaagacatccagagttaccaacttctgtctgcttctgatattatgacattttgaaaaaccatagagaaagtgccttcctttttcaccatcacaatagtgttcatgtgccatttccctatgattagttattttttaattaaataatcgcccactctacaaatattcttcacaggatgctgccatctgagaaaatcctgctaagatagagtaccaatcgtgggcgtaaaatacagtgtattcaaatcagcatagagtataattattagttcatgtaatctagacactatatcacagtctgtgattgcattaactaagaatctgtatcatccttaatatcaagcttgtttcaaagtaagcatgtgcactctatctcatatgtgcttatgtttatgtatatgtatgtatatacatatatatacatatgcacaaagatgtacgtatgtatatatatagaaacataaagagatgtatataaatttaactatatacacatttatacatatatttttatatagacaaaattacatgtatttttacacacttacatttatatatatttacatttatatctatagatgggaagtcagaccctttgtatctcaaactaattcaactgatttatactacttgcatttttaaaaagcagcaacatttcgaactataaacatgagttttctgacttaaaacaataggatgtaacatttgtatatgatattctaactcctcaggacatagctataaaccttctaagttaatatgggagcagaaatattccattaaccactcctacaggggcacactttacacagagccccagctaaatcctcaaatggcttccttccccagaattttcagcacgtaaatcagatactagaaaggaatatattaaaacacagactcacccacgaacactcatagagaaagatagactcaccttaccaataaacagtatcacgcagaggctttgctaaaaggttcaggaaaatcagaatacctcaaattcattccattccattggatcagccaatttaataagtctaacaaaataatttgtcttaatactaccacaaagtatttctacaaattgtttaatgtcatctgatataaagttggtttacatgactcaattttagcgaatgtagcttagttcttagaaaactatctcatctgcaaaaattattccttcaggcaataaatatgtttattaactgcatgagataagtgagaaaccataccagtgagcatggcctcatgtttaataatctgatccaaaattgtgttttccaggttttccttcttgaaaatagaatacttgttgtgacggttaatattatgtgtcaacttcatggaattgagggatgcctagatcactgatgaagtattgtttcttccgggtgtgtctgtgagagtgtagccaaagaaggctgacatgtggaccagtggactgggagaggaaggcccaccctcaatgtgggtgggcaccacccaatcagctgccagttagactagaacaaagccaggagaacagggataaagtagcttgcttggtaagtttactcactctcttcctgtgccctgcggggcagttggcttcctctcctcctgccctcggacatcagactccaggactccaggttctccagtctttggactgggggacttacaccagtgatttcccaggggctctaaggcctttggcctcacactgagagctgcactgtcagcttctctggtcttgaggcttttggacttggactgcaccaggctactaggttctctcttctcccagcttgcagatggcgtatcatgggacttcaccttgtaatcatgtgagccaattctccatgataaactcctaaatgtatattttatatacacatatatacatctatctatccatccatccatccatccagtgggttctgtccttctagagaaccttaatacactctgtctttatccattctttataattatttttattaggaaaatcaaaatacgatatgatagtcttgctatgttgcccaggctaatctttgaacttctgggctcaagcaatattctctccccagccttccaaagtgctgggattacaggtgtgagccactgtacctagcctcattcttttcatatacttttaattctccaaaatattaggcagtaacttcaatattaaagtattttaacaaaataattcaaatgccttttatatggcagaaattctcctggttctatgaccacacagaccttcaatacatctatagttggctctcaacttttaacttgtacagaataacatacctaaaaatagggttttaatggttttgctttttctttggaagacattttcattagagcatcttctataagctatgggcttaaccatgtttctccttctttctttattagaaacagttatctcccaagaacaaaaggctttctttatggtctttttatagtcttttttcatgcaagtttttataaaccacgctctcttgatttaccatttatccatcctagaaactctacccacctccaccaatctcacttatgatggcagcagcagcctgtctggagcggccactgcaaagatgccagctgcagcaagggaggcgtggccagggctgtgcactgtgtggagccaccaagggccaggaacaagcaggagcgctgctccctactgagttggcagggtgggagccccatgcttccaggtgcagctgcagccacccagccacagctccggacctgggcattcctgcgctcttgggggcctgggaagcccccctgcctccacatactaagaagtgcctgctcccactccctggcatctcctcgctccccgcactggctcctgggagaagcaaagttgcggccaagaccaggtgttgtcgcaacctgactggttatgtgtgtgctcgggacagtgctggcatgccagccccctgctgccttgcgcccgtctggactttgggcactgatgagcatgggagagaggctgagtggggactgaggatggttcggtgtgggcctgcaggtaccccttggtataaactgcctaggctacatggatggcatgttgatggtggcaggaggcagactggctcctgggcagaaaggagcagatccacagagaaacccctccttcaagccaagaatggcctgaagcctgggggctgggctgccagttctgggtggagtttgtggcccagaatgagaacttatggtgctttttctgggcctatccatggatgtccatggaccaattagaatgtacctcctcccttccgagcccataaaaaccccagactcagacaaacttagacattgggactaccagccgcaggaaggagctacctactttgtgtctccttgactcttcaggatgacctgcctgcataaaggagccacccaccatgggtctcctctctactcacagctgcacactccctgggacgacctgcctgtggaaaggagctacccaccgtggtatcctgagagctgttctctcgctcaatgaagctcctctgcaccttgctcaccctccagttgtccatgtacctcattcttcctggacatgggacaagaactcaggacttgctgaatggcaggacaaaaagagctgtaacacaaacagggctgaaacatgccccccactcaccatgctatgggcaatgagaaacagagaagagctgtggccttttgcagagcccagaccttggggctcctcaagccagggttgtggcatgctgtaacatgctccttggggctctgtggttcctggtgtctctgagctttcaggtgccaccgcgatcccctgtccagacattggtgcctgcagcagaagctacttgtggtacatctggtccagccacagcctcacatggagctgccaccagtactggtgcctgtagctgccttccgctgcagctggcatgcctgtctgtgcacagtggccaggcctcatgctcgcttgctcacatacctcttactgctctgtgcctggcttgcccttggcaggcatggggatccgggccagtagtgcaagccaagcacagcctgccaggctgagtgggtgcaaggagcccagcgggcacaagcaaaacccagacagaggtgctgccggccacagaggtttctggctggcaaagtgacacccaaggatcccatgacacttacatgcacactttatccattttcctccaatgtatgatttagatcttagcttaaagaaaactttcctcaggaatcatctgttgcgttcaaagttcagtctaagtcagagtaatttcctgtcacaaaagcttattttttgcctttataaataagttgcatccattctttaacatttgctcatttttaaaaatactttattaatgtctatttttatactggattgcatgtaccaagagcgcagttcccatgcctacctgcctatcatagtgaccatggatgacaaggaattagcattctactacaaagagggagactgagatatagtcaccattgttccagggttccaaggaaggcagtaggctctcaaattacccatcgcaaccagggtagatagtgacaaattcttttttttaactgtcttacctggttacccaacacaatccctgggacatagtaagaacataacgagtacttgttgaaaaaaattcaaatgggatgtggaatgcttagaaagagatgtggtaatgacctctaaaactgaagactatataaatgaccaattttagttataaaatttagtttataaaaatatttctcaatcaaataagttaactggcatcactgcctatgaaacagactctctacgcactgacatcctggaagcctctaaagttaaggacaagactctaatctgcagtaacattgctgagggacaagctgaacctttgagagaaagaatctaattatcggagagcacacttttcagaatattacacttcataagctatgtcatctttcagaaactctaagcatatattctgacctgtctttggttttcttcaaaccttttccaaagaagactctaaaggtattttaaagttagagaaatcctaaaatatcatcataatagaatttacagaataaatcaatacatgcagatatatcctattggaagtatttttagagttctaactcagggtgttaagtatgcatctctcttccttattggactaaatggggacttcccttcctactttcccccatctgtacctctttaccaaagacagctggctatcctttttgagcctctggatggcatttcaacagaattttagtgcaatggatgaaggaattgtggtgatgagggatgccagggcgaaggaagagaaggcgtgagatgggcactcaacactaataggttttgaggaataagttaaggatagccagactctgctctaataaaaagcctgctaagatccttctctgagtcctgatgattgtttttcttttaggggatccaaatacctgtttctctttcctgtaattcttctaattacgtctaccagaatccctctcagtccagtattaaacatattaaagtccacagtctctgaagctaccctagaattataatatacccagggtatttgtgttaaatttttttatgtttttatactttatcaatcttttaatactttatgatttctccttactcctccttctgtaccatcttctcgtcctcttcttcttgcttttaaaaagtaaactaggtaagacaagattatatcacttgcaaagaacctaagaatcatctctgtttcaaagtcaaatggaagcagagcattccacgacaattccagccaatagttaaataaagtatagaactcaagcatggattcttttgggactgaaggaactgatgggatggaatcaaagaaaagttatagcaagggctttctctccacttgattccttttaatgctgcccttttagatactagtctagattatcttaaagtcacatgacactacagagctatatagaggcaaaatgagaacatcaaaagaggaaagaagattgaagacaaaagaggaggctggaaggcagtagccattaaaggggtatgcaatcatggacaaatgcagatagagtttaagcaaattagggataatcagtacatttaccgatatttagtagatgtctttgggccaaagaaataaaggcagaaaataaggtgaaaatgaaagcaagtagaaaacaaatacagaagagtataggcccaccatacaaccatctgtgagttctacggactgtttttcaagatgccttaaccacacaagcatcaccttggatgaattatattgaaaagctattcacactgggtcagctaatgatgaaatgggtgctttcaattgttattttaaatggaaatactccatgccttagaaaaatgtctgcatttaaattttttttaaccagtaacctcccttcaacccctgcttcccagccttatttaatattaattgaaattttctggtaaagtattagattttacccatccgcagttagttactattgtatcagaattatggaattctttaaatcacagcacttcagctgattatgagtgtgtgtatattgtacacatattgtattctaagtattttaatatataaattgcattctaaatttttaaaatacttttcaagttatagttcttttaaaggacatatttagtttactaagcaaaataatctgaccttaagttgttcttccaaagcagcagttgcgtgatctccactagattcatcaactaccaccaccatgtgagtgagagaattgaccctgacttgttcttgttctagatcttcttgaagcacctgaaagataaaatgttttaaaggaaattaaaatgatattcttacatgtgtgttgaaatgatttgctctcaaatggtgaaatttatttctgctacatctcaggtactcccattttttattaacctaaaaccattccaagccaattttctgctatgacgctcagcaaaatttatatgttctattgttaatttaactggaaagtatctagagaagacaaatgttaagaaaggtacagcaggatgttctccttctcatcccaccccctttctccctttcaaggacttttttcctacaactatcagcacttctggcattttcaggctcttcttctctactgaacttctccattaccataaaaataaaacaaactcttgatccaacaaaccggtcctcctactgtcctattatgtgttcctcttcactgaaaaaaaaaaaaacaaatgtatcctatagttactgtgcctacatatttatcctactattcactttgcccactaacccattgaaatatcttttgtaaaggacaccatcaactttcatgttcctaaattcaataaccatttgttatagcgtcttacttgacatgttgattactaacctaattggccactccctcattcttgacaccttctcttgattaccctcctacctatgtgctactttttttattttttttttctattttggagacggattctcactgtgtcacccagggtggaatgccaatggcatgatctcggctcactgcaaactccacctaccgggttcaagggattctcctgcctcagcctcccgagtagctgagattacaggtgcacaccaccacgcccagctaattttttgtattttcagttgagacgggatttcaccacgttggccaggctgctctcaaactcctgacctcaggtaatctacccacctcagcctcccaaagtgctgagattacaaacgtgagccactgtgcctggcctatacactactttttagctcctttactcgttttttcccttccgctcaaactacaaatcagatgtcagtccgatttataaaaaccaatagatttctatcatactaagaaagaaaatttaacttctctacctgaaattcttatatgatctagcacctgactacctcaccagtctaattgtataccattctcgccctcacagtgtttcagaatgacttgctttgtctctcttccaaaaatgtgtcaagctgttccctctaccaggattgcttttcttccagatgtttaaatcatttctttatcattcaggactcaatgtaagtgtcacctacctagagcagcttttcatgagcaaactatccaatgttgctccctagtaattcaccatttctgtcatttttttaatcatagtattgtcactactcaataatttcttatgtatcagcttagtccttttgtctctacttactataataggcagtccactagaacagagatgccctctgtccttctcactatgtattacaagcaaataaagatcaataaacatttgtcagataaatggtaccatgtgggggtttggggaaaacatgcacagatgagtttgttccttcctgattgcacaaagattacaatataataggaagaattagtgatttttggtgtaatcacaattacactaacctcaacagaaaataaccacttggtctcaactgaaccctaggataaaaccagaataattcaaatactgcctttctaacttacaaatgtggctctgaaaaaatcatttccccctattaagtgaggctgtcacaaaacagtatttccaatctttttaaaaacatgatgtacaattattttgtaatgatgaacaggggtaaacacaggaataaattaggggtaaacaaaggaggctgctctagaaccaaggtatgttgcctgggtgctccagatcccataagaccttaccctgttacactatttattattgggatttctctgaatagctatttgagacttctaggcaactactttgtttcttagaacattttgttacataacacaagagtggagaaacaagtttgggacatttcccgttactttctggcaaacgtgctgtccctacttgcaaaacaacagtgcttagcacctatcagtctagctcttaggtattcaaactctatggcaggtggaagggaacttattaggatggctgaatcacaatctcaaatgcatgagcatttttatcctaggcttcttattttcgaagcctcaacattttagaacactataaaatcacttctttttacttcgtctctctagattttcatactacattttcaagtgaagcaatttagaataaaatgactatgcatctattttgtgtgtgcaatctatactgcctatcatgcctttgacattccagagcttataatggttaataaaactctttttgccatgaggccaaaaatggaaacattaaaattcagagttgtccttgacagtcatgttgagtctgtgttttctgagttatataagacaggactgggaacattttgaaggtgtcagccgggaatgtttcaaataataattaaaatgataatttggtggccagtgtatcataagttggttttctgaatttagtcaattcttttctgtccttcaatgagtatatataattacatatattacaaaattacaagtaaataatgccagttttcatttttacatgtaaattgctttttcacaattttaatatattttacttaagaagtgtaagaaaaacattggatccatggaatgaatccaactcttattgagtcttttaaagtctatgtgatcaaacgtactatattctccattacttagttgttctgattttgtttcgttcatctatttgttttataattggaaatggcattcttgccatattgatcaagggtttatattttatgcttggcagaagtgctaacgtaaagtaccactaaagagagttgtgagatgatagcattaaaatctaacacaagaaccctctggacttacggtgagtacaaggaaataaaggagtggggaaaggctctctacagtgactaagaacgttgaagagtccagagtgctggagtagatttgcataaggtacatttgatttaatgttatttccagtatctcttctcctctatgactttttaaaattgtatttcttctttctcagctaattaggaattaaactaaaaaaggttaaactgacttttttgagcacactaaatagctgtaagacaaaagctatggtaaaacagtaagcacgtctcctattttctcagacttcaaatgcgaaataaatattagtgaatataactgtattagctaatctccttaatatcagcaaaatacagattatgaactatgcaacgttcagggtttacttttacactgattcttacaagtagcagaaacgccagacataaaaagctggagttaaaaagttcaattgttctgccaaactaggaatccatgaataaaggccttgatcattggggtaaagaatgcctgcctgtttctccagttggaaagaaatgaattctcaagagtatttaaaaaaaataatatgctaaagtgttgtaaggctatatttaattacaattttaaatactgacttcttatggatttcaatttgtcatagatgaatttatacaacggagatttatattggatttgctaattaagcctgaaatatgagccaaatagtttccaaatatagatgcatccctagagaagtacacaaaaatgtttgtctgtcagaaaataataccttcaaattaaaatattgtaatataatattgttaaaatgttttcctttattaaaagcttccagattgtacatacacatacacatatatacacacatactaggtactttattatgcatttattttcattattttattaaaggaatgcttttgtaacacttaccagatttcaaacatctatcatgttcctagttaaatttcattaccattattagatacaaatgttaccaatgtttgttgtcaaatgtcaaataatgtatttttttctttatgacaagagaaaaggccaacagtgagatgtaacattaagaatgcctagattggacaaacagtttttgttatacctctgtgaataattgtatttcttctaaataagtctctagttaaagggcttaacaaaatttgttactcccttagtacatgttcccaattttattatttaaacctgacttttcttgtacttcttttaaatgccatcagtgatactgaattcttctggctcttgtccatgtcaagttggttttcaaaagtggcttagaaaaaccactggagagccacttcagtgtttattctagatctatgctattttaccctttcttagaacacatgtaaaataatacttaggaaataaagacatggaattatgtaaggctagggaaatttttgatttgatgtttaaaggtgaagagcaataattaatcgaaaggcagtataatagaaaacaaaaacaaggatgggtatcctgtaaattcgatgggagaagcttttgttttacttgtctatttcttttggccatagcatagactcagctatggaaagaacaggaaaagaacagctgttacctatatgtaaagttttttttttttttaactactcctccgacttcattgaatacccaacagctaattgccggtacttgcaggtcacacacacacaaacacgcacacgcacacacacacacacacacacacacaaaacacacccctagaaacaacacagaacgctgttcatcatgaattggaaggcaatctattgtctccaaaaatgactttaaaattaatatatttagatgtttaattacaaatattcagtagtttgtagtttatctcaataaatgcacacataaggaaagactaacgagaaaaaaattgtagcaaacataaaatttgcaaaggacattaagaattcagaaggttctaggaatagagttgagtctaacatccaggaaagaagtatcttaaaaaagctgtctcatgaacaaaaaaatccctagatactaatgatcatgttaattcaagacatctggacaggaattgactttttttcaaataaaaacttcaagtacagatcagaaagtgttaggatttcttgggaaatgatggggtggtaggtaatttatttttttcactcttttcctctatgccccattccttctaccacctctacactgggctaggctctatatcccttgctggcctgaatgatatgatctggaaaggactttcgattttatttgcagtgaaatattcactttgctaagcctggctggtcacagtattgtctagctttccatgaagatctatttacggtatataactttgttataaatttgctgaatattttaaataatcttcctcaacaggctaccctagaaaagcttttgatattcacttacttaaatgtgattgaatatctttattagttcttatatcagaacacactgattttatctttttgttagaaatgaatgtttatgtttctgccaactcctaagctaccaaatgggggttctgaaagactgtttcaatggagagatttgaaaggctatacaagcacactaaatgcttctcaatagcctgaaggggactcaataaatacgaaaagaaactgttttaaaaataaagtagacaattaatgtactcctacatatggaaaaggacataggatgaaatagattgaccaaaacttgtgcatgactatgaggagacagtaaaactgtagtcaaaagtgtagcatctgaaatcagattttctatgtgtaattcctggaagcatcaataaccaatcacgtgactttgagaaagtcatcaaccacaccaagcctcagcttcctaatttgtaaaactaagataataaaactgcctatttctttatgtggttaagaagattgaataaggtaaaactgttttgcattttgcctggaaaacaatataaattccaaaaatattagcatctaattagttgaaagaattcatatttagccatatttatatcaaagttttgaaactaaactgcaatgacctaacctaatactaatctattttaccctcatctaatacattctgactatcatcctttctaatagacatcataagtgcaggaagagaatgtgatttttgaaaagtcatgaaaacaagtgaagttacagcaaagttttaaggtctggagaaatatacagtaagtgttaaatccttaaataatacctgaacttccaatttatttacactacattaataaaagtaggttcaaactacctcatctgatggttatcacagaaaaatttgcatgggcagacatatgtcatggagtgaggacagtccctaatcacgaaatggtagccctcaattctcttgcctttcctactctttctacaatccatgcatgcacccacccatacattctgcatatagttacagaattaaaatcagattaaaaaccaataacattgaataaataattataaaatgcctttactgaaaataattattgaaaaagaaaagaagattattgggagagagttggggtggaaagtttcaggcagagcacagaggaaatgctatgcattgtgctgctaacagaatatagttgtgaaattcagttccaatgattatcctcctgctcagacggtattgccattcttatcataagcctatattcctgtttcccttatagtctctttttcctctattttaaagaactacaggagtaatggtgatgaattatttcattaagcattttgattctgagtatttaatgtgtagctaccactactgcttactctatgtttgaagactcatatgcacacagtctctgtaccttctatctagacattcccaatcctgggaatccaaatgccacaacatcttcaaatctctttgtcacttctctgcaactgctctagtctctaggatctcaggtggagtcaagcttcactggaatctcaaaatggagagaaatggtctcaaaggcagacaggtcaaagttaaaatcagaatctaccaattaatactgaagttaccttgaacaactccttaaactctttgaacacatctatttgtctgtaaaatcaagtattaatatccttccaggccagacacttacagaacattctattctaccaccacagaatgtacattattctcatctgcacgtggatcattatcaaaaattgaaaatgtgctaggccacaaggtggttcttaacacatttttaaaaaaatcaaaatcatatcaagcatcttcttgcaccacagtggaaaaaaactagaaatgagtaccaagaagactccttaaatctatacaaatacatggaaattaaacaacctgctcctgaatgatctttggacaatgaaatcaaggaagaaattaaaactttttgaaacaaataaaaagagacatacaacatacctccacctctgggatacagcaaaagcagtcctaagatggaaatttatagcattaactgcctacaccaaaaagatagaaagatctaaaattagcaaactaatattgtacttcaatgaactagaaaaccaagaacaaaccgaaaccaaagctagcagaatataagaaataacaatgatcagagcagaactaaatgaaactgagataataaaagacaaaaaattaaaaaaattagagagttttctttgaaaagataaacaaaattaataggccactagctagattaaccaagaaaaaaacagaagaatcaaataagcaaagtcagagatgatagatgtgacgttacaactgataccatagaaatacgaaagattatcagactactatgggcatctctaggtacacaaattagaaaatctggaggaaatgaataaattcctggatacatatcaactcccaaaattgaaccacaagaagcaaaaatcttggacagaccaataacaaatagtgaaactgaatcagtaataaatatctcccaataaaataaagctcaggaccagacgtattcacagccgaattctaccagacatgcaaagaactggtaccaatcctattgtaactgttgcaaaatatcaaacaagaggaaattctccctaattaattctacgaagccagtatcaccatgataccaaaggcaggtaaggacacaacaaaaaggaaaccacaggccaatatccctgatgaacatagatgcaaaaatcctcaacagaatgctagcaaaccaaacccaaaagcataacaaaaagataatacatgacaataacgtgagctttatgccaggtaggcagggatatatgcagagcaatatctgtgattcaccacataacacaatatatgttttgtgtggtgcaatatatgcagagcaatatatgtgattcaccacataaaaagaattaaaaacaaaaaacatatgatcatctcaatagatgcagaaaaggcatttgataaaatccagcctctccccaagataaagaccctcaacaactaggcattgaaagaacatatctcaaaataacaaaagtcatatatgacaaaccaagagccaacatcatactaaacaggaacatgttgagagcacccccctcccccaagaactacaacaagacaaggatacccattttcactgctccaattcaacatagtactggaagtcctagctagagcaatcaggcaagagaaagaaataaaaggcatccaaattgggaaaaagaaagtcaaatgatttctcttcactgatgataggattttacatctagaaaacccttaagactcctccaaaaggaccctatatttgataaatgacttcagtaaagtttcaggatatgaaatcaatgtacaaaattggtagcatttctatacaccaataatgatcaagctgagaaccaaatcaagaactcaatctcatttacaacaactacaaaaaaaaaaaatacctaggaatgcctttaaacaaaaaagtgaaaggtgtctacaaggagaactacaaaacacccatgaaataaatcatagatgacacaaacaaatggaaaaactttccctgctcatggattgggagcatcaatattgttaaaataaccacactgctcaaagcaatttacagattgaacacagtccttataaattaccaacatcatttttcacagaattagaaaaagatagtaaaatacatagagaatcaaaaaagagcccaaatagtcaaagcaatgctaagcaagaagaataaagttgaaggcatcacattacctgacttcaaattatactaaaaggctacagtaaccaaaacagtatggtactggtataaaaacagatacatatagattgatttaaccaaattaagaacccagatataaaaccacatatctatgaccaacacatctttaacaaagtaaaaaaatgtatatatacactggggaaaggacatcctattcagtaaattgtgctgtaaatattggatagtcataagcagaagaatgaaactgggtcataaatcaccatatacaaaaattaactcaaaatgtattaaagacttaaatgtaagacctgaaaatataaaaatcctaaaagaaaacctaggaaaaactcttctcgacactggcttgggcaaagaatttatgactaagtactcaaaaacaaaagtagacaaatggaacttaattttaaaatcttctgaacagcaaaaacaaacaaacaaaaaaacaaaaaacaatcaacagaatgaacagacaacttatagaatggaaaacaattccgaactatacatctaacaaaaaactaatatctagaatctaaaagtaactcaacaagaagaaaaatagataaccccattaaaaagtaggcaaaggacattagcagacattttttaaaagaagatatacaagtggccaacaaacatatgagaaaatgctcaacatcactaatcatcagagaaatgcaaattaaaaccacaaggagatatgatctcacaccaatcagtatggctattatttgtttttttcaatgtcatttaaaaatttgtgggtacagagtaggtgtatttgtggggtacatgagatgttttgatacaggcatgcaaagtgaaataatcacatcatggagaatttagtatctatcaccttaagcatttgtcctttgtcttacaagcaacctaattatatgctttcacagttattgtaaaatgtacaagttattattgaccatagttactgtatgatatgatcaaatattatgtcttttcattctttctaactgtaatttttgtacccaataaccatccccacctcccttccaccacccttcccagtctctgataaccatccttctactctctatttccatgacttcaattgttttaatttttagatcccacaaataagtcagaacataagagatgtttgtctttctgtgcctggcttatttcacttaacataacgatctctagttccatccacattgttccaaatgacagtatctcatttttttaaggggatacctgtcattaaaaaagtcaaacaacaacaggtgttggcaaggatgtggagaaaagaaaatgtttattcactcttggtgggaatgtaagttaatataaacattatgtaaaacagtatggagatttctcaaagaacttaaaacacaactattggatcctgcaatcctagtactgggtatatactcaacaaaaacaacaaaaagtgttacatgaaaaagctacctgcagttgtatgtttatcatagcactatttacaatagcaaagaatcaacctaagcgtccatcagtaaatgattggataaagaaaatgtgatatgcacatgtatatatgtgtgtatatacgcatatatatatatatatatatacacacacacatacatatatatacacacatatatacacacacaccacagaacactacacagcctaagaaagtatgaaatcctgtcttttgcagttacatgaataggaactataggccattatcctaagtgaagtaacttggaaacagaaacctaaatgcaacatgttctcgcttataagaagaaactaaacaaagggtacacacggacatctagagtggaataatataaactggaaactacaaaagattataggctggtaggggggtgaggggtgaaaaattacctattgagtatagtgttcgctattcagattatggatatactaaaatcccagactccaccactacacgatatatccatgtaacaaacctgcacatgcaccccctcaatctattttaaaacttcttctaagacatgcttattactagagttaaatgagacaatacattaacttcagcttgtacagtgcttagatttggtaggtggtgaggaaatgcttattttctttcatttctgacgtattcacattatccttgcattcttacactgagattcatggaaatagcccttttgagcatcactatttatttctaataacttggtaatcacattatatttccattattaaatatcctcagtgtgccaaaactgtagaccattatgtaaaaatagtttagtgcttttttagtcttactagatatgacttagataaaaatttaattgttaaaggatacagtatcattacttccaatgaataagagagtactaccagatgtaccagtagaaatctactagtattagaaatccactagaaattctgttcataacagaaatattaaacaggatagttctccatattcttcagaaaaagtatcatattcaaccttatattttaacacgggattggatttacggacatgcattttgttataagatacggtcatacatttgataaggaaaattattgccttaaaattcatgttatcatgtgtgtcttagctttcttgtaaggtttccctaaaatgcattttaaaatgttttttataattagtttatctacattattaattttgtattacctatacgaaagaactgaaattgattgttacagtactggttcagagagagagagacattttacatgagactaactcagtaaattagaaatagggtacttatttttttcctttaaacaccattggagaggtcagtgtcttctcatgaggaagtattacaagagtaatgaagtataataactaatgttagtgcctctaagatgacagagtcttgatcaggtataattttcgtagctataccgatatactgtcaaacaaagctgtgacattctaagtaatgttactgaatcaatactcagtaatttctaataaagtaaataataatctgatagctagaaatacttgatttgtaaaataagaatatgggcatggattttatattattattattttaataatctatagcattactgtgcaaatatacccttggaatatgatgcttgttaatagaattcttatgggatattagatgtcttctcaattcgattttaaaaattgtaactgaatatcatgcacatactactacgtagactataaaagtgtgatgttcttttttacataaacttccaatcatttatgtcaaaataatactaccactcaaaccaatttcatagtcaatggtttagcactattaagatatttgcatatgggaatgcaacagagatagaaggaaaaaaggaaagtcagagattgaagacaccagagataacatcaccaggtaagccactttacagatgtatttttctacagctttatgaatttttttttgctgtatgcccaacgttttaattgaaattatcaaactttcatgcccttgtcagaaagttagccatgatggagacgatttggataataaaactagtcaatataatcagaacatgtgttctaaaaacatttactgagcatcaattattgactaagcactctgaaaacacaaaagaaatctggctctctggttataatacagtattttttcagattatagtgtttatcccccttaccatcataaccattaaactttcattaagcacttatgagggcaaaagacaggaaataaaatgaaacttcatagcagaaacaaacaacatgtaattttaaccttgctaaatatgagagtgagtttgctaaccactaaaagcaccacttgatcctatggcactgtcaaacttaactgaatcacttatccttcttccaactattgcatttctctttttcactgcctattttcttaattaccaatctcaagtcccaattgcccagtcccagaatctattactttgagctttttgttcatatcctaaatctagtcctattggttttgatttgatatccagaatgctttgtacctgtttacaatttttgttgtcattgctttcattcaggctctatatactttcagcaatatcctcttaacatgttttccggcctcctgtttctctgctcttttatttatcctcaaaaaatatcttcttaaatattaagataagttttcctaaattgctgctatttctagtttaatttctcatgaataatggtttcctgttactcatagaactactactgcaaatgcctgagtcttttatataagactcatgatcaccctccatgatcaggcttaaatcctccagcattcagtatagtacaagacatcgtaaatgattggtttctgcattcttcacagcacccatgtgctataatgagggtttgttcagtgatatggaatagaatgcaatggaatgaaatgaaatgtcagatcctttggcagaattatacctaatccttctctgtaacatgaacatctagatcattttaaaggtcaccagatgaggatatttcacaatcttggcaacccaaatgtctgcctttaactaaccttcaagaaaaggataggtgactgagtttctaagaggctacttagtttgtattaatcagtatttcacatataaccttcactgaagtcagaatatagagtatatattcacatcggcaaattcttgtaatttgtaaagtctttgttgatgctgtcaccaaggttatgcatctatgcacaaaagtctaaatctctcaaaagaatggaaaacctagctagtaaactcagctttaaacttcatcgcagtctcactgtgccaggagacaaaagatttcactgttaaatattttccttttgaaaaaaatgcctccaaaatggcaaacttctttactattaatgaaagctcaaggcttttcctcctcaatagcatcatgccactccttcgagggaaatcctttcattctttgtcaacatcactaataaattctaccccttaagacaaaaaagaccagctagaattatatgtgatatattttttcacaggggaatgagaggttcgatttgtttactccccagaaagactcactcttgggtgcctcaaagctaaagcaaacctctaaattctctccctacagcaatgtctatgaaggatgagtggtttctcccaaatggtgcagccaattgaacttttcttggttacccagagtaaagagtttggctagatttaatagtaaccaccatataggatcaattgctttaccttacctaattgccaggttcagtaaaagtgacttatcttcctgacatttcacagtgtctgaatttctagcctgcctcataataaaatgctgttgaaatgaagatagcaaaggatcctgtcacagaatatacagaagcatatctgtaatattcacagtgtacttgcaagatttgcaaacattttaatcttgccctccagttgagagagagagagcaggcgacctctgatctgagcagaatttaaatcaattcccagcaataaaatctgtatcttttctttaattttgtcatctgcaatcatctttaagaaaaaatggtgatggcacaaggatttaatgtctatctacacaaagctaaaaataaatattatattaggttagaagtttggtgatgcagcagatgggagttgcttttgtggggactctaaggttactgatgcattttgttgtcagaaggagaaatttccttactttcaatgatttacaattcttgggaaaaaaagctgcaaagcgattcaacgactatataaataaggctttagtttgaactcagttacccaaagaagtaacatttattttcttttgttttatgaagtgtggcaagactaacaaaacagtgttcctttaattctgtatgtatgctccttttagtcttaaaagacaatataatgtacatgtttcaggtttaaataaagtcaactctttgctaaattgtttgatgttaagtcaccttcttctcgccaaaattgttgccaagaaacaaaagagcattatcaatattcaggacttgaatatgaatctttcccttaatttttataaaaaaaaaatctgtcaaatatttcaaaaaatattgtcaaatctgtcaaaaaaaagagtgctcaaatagttaaaagtaggagttggccttactctctgagccagaaaaccaatgccttctggcctctttatgccctttaaataaataaataatgcctggaggtaaaatgttacataatcaacttgcatatactcctgttgccttcttttgtttcacattttttcttcaaggcaatttcatagtcattagaaatggcatactttcaagtaatgaataatatatttaaattttatgacaatatttgtcaaacgttttccatttcattcacattatatctttcagaaaaaactacaaaacatttcaggtacctggcagaatattaagatcctggatagcttgtctcaccttaatgaagagtctgttcagcgtcccaagctaagaacttccttcatagctgccctaggttatccgtacttagctatgctaacattcttcttctactgctcttttggagctcttctccctggatttcgctttacactccaggcatccagcagcagtgtcctgccttctgatgttcagtgttacgtggcctaatcttggccttttctaaaatacttcaacttccaaaagtattggacacatttaaactgtgactggaaggaacactagaaacaaactcactcttttatttccaaagtaaagatacagagaacctgggacattaagtgatgtttggaaaatgacaatttagttagtggtagaactggagctcgaattctggcttctagtgggagaagtttgtcttgggttagattcctccaaaaacacatcctgaacaaaagatttgtgaacaaataaatggtttatttggagggtgaactcgtaaggcattatgagagcacggggacgttcaggaagttaccctgtggatacctggagctcagtcttactggggaatctctgaaagactgtggagaatataccttagaaatgtcccactatgggacaaagattctacaggatttctctatcaacttttactcctcattggctaagggcagctctggtggcactaattccacttcctgtccaccttcaaactggctgaaatggttctgcaccagaaataccctccggtagagagaagccattgctgtacatcaaccttgtccaatccatgacccaggatggctttcaatgtggcccaacacaaatttgtaaactttcttaaaatattttttcaattatttcttttagttcaccagctatcattagtgttagtatattttatgtgtggcccaagacaattcttccaatgtcgcccagggaagccaacgggttggacacccctggtttatatagacactttctgcatgtaacttccagtgtaggccaagggaaagagggcagatatagtgtcaacgagagaagcaaatgtgccacatcggaaaagcggtacggttagagaactagcactgtacctaacttcttcttcaggtgctcaattagtatctatatgacaagtaatcacagttacaatttctacataattgcaatacagttgatgtttttttcctgatggcatagcagacggggattaccatagttacagttcttcttaaatgctagatcttagaggactcctgggggtcaataatagtaagggctggccccatttgtcattcaaaactgaagctcattaaacttaaaaaaaactctagaacttagaaataaatgtatctttcatttgcatggaagaactgtaaagctatatatgactgaatattataaaaagagagaattaagtttgacaaaaggcagatttcgaaggtatgaggtaaaggagcagatattcctattcaaagccataaatccaaaaaccacagatcataagtagagttgccagataaaataaaagacactcagcaaaatgtgaatttcagataaacaatgaacaatttgggacacacactaagaaaattatttgttgtttatctgaaatttacatttaagtaggcttcttttatttgtgtctgctaaatgtggcaaccctaatcctgggacaattacaaaggatcttgtgtgtgtgtgtgtttcctcatgaattgagcaggagcctatttcaacaataaaactcagagctaattgtaatattttatggcacttattaaaataaagcaccctcataattttggataagaaatattattgtagaagtctcaataacagaaacaaaaaaaaatgctttctggcagcgagggagcataactggaaatgtacaagtaaactgaagaaaaaagatggaaatattaacatttaaaaaatgtcatattctatagaaaagcaatgcttcagactctcatttatcatcaagcttggccagcttcaatttactataaattgaatgtaaaattacattaaaaaaaatcgtagccttattatttaaatttgcattacaagtaatccctatgaagtctgtcttccaggaaagcaaatttttaataaatcacataccctgcgttgttctcatccacaaatatgtttgatttcttttccaaatacgaaaagcctagctatgctgtattttttaaaaaaacaacaacaaatgtcttaatccattttgtgctgctgtaacaaaaataactgagaatgaggtaatttaggaagaatgtacctttattttttcacagttctcgagtttgggaaatccaagatcaagatgttagcatctggtgagggccttttcacagagttttcacatggtggtgcatggtggagggtcaagagataggagaacactgtgtgaagcctcttttatatgggacttgatcctattcttaagggaggagccctgatggattattcacccttaaatattccatctcctaatacaatcacctgaattttggaggggacttattcaagccattgcaacaaagattgcaaaaacaattaggtaaaaataatttttaaaatatggctgactttaagttttaattctctcccatcaaccatgtcatctgtgttactgtgtataggtactatacacagagtttgctttctagtagaaagcacgcaacataagatacacctaccttatgttgttgtacttggcgttttaggtcttcaagatcaggtccaagaggctcttcctccattttccttgttctttcttctgtttttgttagccagtcattcaactctttcagtttctgattctggagatccattaaaactctatgtaaactgaaaatttgaaagaagcctattatgacctctttgaaagcaacttattactgaacatcacaatgtaaaacaatagaatttataatatatggaatgttcgcatttgggggcatctattggacattgagaaggatgtaagtaaagcccactatcagtcaccccggaactattatttctcagacttataatagttcacaaatcctgatttctaaaaactttcacatagtcaactaaatgtgaacatgctaactgaagtgcaaagcatctgataattgactaagtagtatattttggcagttgttcgtttacattctcattatttagtatgtgtggtggttaaagatggccacaaattctttgtcacttttcccttcaagagatgaggtctattttccatccctgtgaatatgatctggacttgtgtttttttttttgaccacagaatgtggcataactgacaccacaccaattccaagtgtaggctataaaagaactggcagcatttgtatttcttcctctcttgaagcctagattccatgctgtaaaggaggccaggctacactaccgaatcattagagaccatataggagtgattctgcaggataaaatactgtattagaagtgagcttccagctcagcacagcccaaggggtgacccccagctataaaactagtaatataaaaacaacctggctgagccctgcttatattctcggtcttcagatcatgacgcaattataaattgttttaacccattaagtttggacgtcatttgatacacacaaatagactagagaaagggtgctttttccccacaaagatatagaaaatagtgggctgggtaatgaatttaaagtccaaaggcctaggttcacagcccagcggtaagctctacaaccaggttcttaaacgttctcaattacatttccagcatcagggacatgggataatgttttgcctattaattacacaactttatgttgaggatgaaaacacattattgttcattcattaattcaaccaaaatttgagatgcaaatgagaagtgctgatggttattttaaaggaaatactctttataaacatcatgtttaaagcatttttcaaaactatattctgaacattgatcttataatttgaattaggaatatgttattttgaatacataattttactctaaaatctttactggaagtttccattaatcatcacatttaaacacacaaagtgcacacatagctgagagtgttttttaacagatttaattttttggctgttttagattcacgaaaaattaatgagattataatacaaagagttatcatataacttgcactcagtctcccgttttattaacatcttatgttattatggaacatctcttacaattaatgaaccaatatttgtgcattagctggagactattattatattctgatttccttaaactattttttgtatttcagtatctctccaaggattccatattacactcaattgtcctgtttccttaatctgcttttggctatgacagtttctcagaatttttctggcagtttttaaaagtgctggccaggctggtattttgtagtatgcctctcagtggggatttgtctgattttttttcctcataattaaactggggtttttgaaagaccacagaagtaatgggccattttaagcacattttataaagcatatataccctcaacgtgacttatcaatgttaaatgtgaccacctggctaaagtaataggtgtcatgtttatccactataaagttactctttccccctcttttcacactgttttttaataagaaagtcactatacacagcccctgtggagtggggagttacattccctctccgtgagggcagagaagttacataagtttttggagttttttctgcattggagatttgtctctattcctccatttatttatgaaattatttatttacatagcatggactcatgtatagttatttgatactttgggctaaatccaatactagtttttgctttggatttttgctcaaatagttccagctttggacattgggaagtctcttagttggcttctttgacacatcccatcagtgttttttgtttagagcgagaccgtggagtttagcatgttcttactatctggcactaccaaatgttccaggctcattttctatattccctttcctagtgttagaatcagctgtttctccacagtgttctggttcctttttttttttttttttttttttttctttaaagaatgttactgaaacccaagatcctgttgctaggtatgctccttgcttctagggtgttgtagcttacaggacctctgggttgacataaagaagtggatgtgtgagtgtgtactcacccataaatacttctatatataattatctcatctgtattaacctaatattaatttatccatctctctccaccttgtgacttctgttccttatctgtgaactacctcttcaacttttttttgaactacctcttcaacattttgagttataagaaactcaaaaatgatttctttaaactagaagttgagatgaccgctgttcatgtttggctcctcatgctgctgaatccacagacagagaaaggggttaccatacagaacctaagcacaaatggtcaactgagttcacccaatacaatgcggggcaagtagtactacattagaaaactatgggcatttgccaggagtctcttagtatacccatatatgatagtgttaaccaataaaaaaaacagaagatactcgatcaatatggaaacactaataatatggttctttggaaggatgttttttatttcccactaaggtcaaagtacgcaactagaagaaattctgccatagtaaccaagacagcattgtattagcataaaaactgatcagtggaacataatagagaacccaggaataaattaatgcatttgcattcaactgattttggacatgggtgtcaagaacacaccgtgaggacaggacaccctcttcagcaaatgctaccaggaaaagtaagaatctacatgcagaagaatgaaattagacccttatcccttgccacatacaaaaaccaatttgaaatggattaaaaacttaaatttaagactcaaaactctcaatctattagtagaaaacatagaggacaagcttcatcacaattatttgggcaataacttttgaatatgactgtaaaagcacaagcaacaaaagcaaaaatagactgaggacttataccaaactaaaaatttctgcacagcaaaaaaattaaaattaaaattaaaaattaacagagtaaagagatatccaatagaatgagaaaaatatttgcaaactatatatctgatgggggttcatataaaaatatggaagaaattcaaccaactccatagcaagaaaacaaataacctgattaaaaataggcaaaagaccaaaatagacatttatcataaaagggacaaatggataacacagatatgaaaaaatgctcaacagcactaatcatctgggaaatgcaaattaaaaccacaatgaggtatcagcttacttgcaaagaaaagggaacacttatacactgtttgtgggagtgtaaattatttcaactattgttgaaaacagtgtggtgattccacaaagacctcaaaacagaactaccattggacccagcaatcctattattgtgtatacacttaaaggaatataaatcattctaccaaaaagacacatgcacacatatgttcgtggcagcactattcacaatcacaaagacaatcaacctaaatgcttatcagtggtaaactggataaagaaaatgtggtaaacacataccatggaatactatgcggccatgaaaaagagtaagattatgttctttgcagaaacgtagatgaagctggaggccattatccttagcaaaataacgcagaaacagaaaaccaaatacaccacgttctcacttataagtgggagctaaatgatgagaacacatgggcacatagagggaaacaacagacatggggcctattggagtttggagggtggcagaaggaaagaattaggaaaaaataactaatgagtactaagcttatacctggtgatgaaataatctgtacaataaacttccatgacacaagtttacccatgtaacaaaactgcacatgtacccttgcacctaaaagttaaaatataatagtaattaacgatatctttgtcaaaagaaaaaagaagagattatcacctcacttttgttagcatggctactatccaaaacaaaaaaagataaatgttgataacgatttaggaaaaaggcatgtattacgtacctgcaaaagttaaaaattactaattaaaaaaaagaaaacctttacacactgtaaatgggaatggcaatcagtacaggcatcatggaaaacagtatgaaggctccttgaaatatgaacaacaaaactacaatatgatacaaaatcccactatgaattatatatacaaaggaaatgaaatcagtatgtcaaagaaatatctgcactaccatttttattgcagcactattcatggccaagatatggaatcaatccaaatatccaccaacatatgaacggataaagaaaatgtggtatacatatatacaatggaatactattcagccataaaaaagaataaaatactgtcatttgcaacaacatggatgaacctggaggatattatgttaagtgaaataagccagtaaagaaagaaaaccactgcctaatttcacttatatgtggaatctaaaagagctgatcccacagaagtagggaatgaatagtggttaccagaggctgaggtggttatggggaagggggaggtatggagatacttttcaagggatatatagtcacagtcaaaatattcaagtgatgtattttacagcatggtgactacagctaatgaaaatatactcttgaaaaatgtagagagagaggacgttaaatattcccaccataaaaatgataaatatgtaaggtaatgcatatgttaattagctagattcaactgttccacaatatatatttactcagaagcatcacgttgtacatgatgaatatacaattttatctgtcaatttaaagtagggtttaaaaagcaatgtttagaaattgatagcatttcaaacaataaaatataaaagttgggtctgttgagtgtgtgtgtggatgctgcatactattggcaggaaagatagaacacactcaaatatgtttcgctcagtagactacttacacatttatgtgaagggtcgggggaaaaataataaacgatagtgaaggagccaggacctaacaacaaagacaactgacctagcatccccggaactggaagaaaaaaggaagagagctgttgccggagctcagtgagaattagagacatggaacaagagctgtccaacagtagctgtagtttaagaggaacacaattccagccactccacagtaagaaacagaagaggaagagaaaagtaccacaatctctgctttcaccctcttgccagtgcctcccattggctgaagtactttagcaaccaaaggccaagaggaacctgggtaacagaaaatctagacttcatcctctttgaacagagcaagaaggagaaaagtgaaatgaatctgctaaacagagtaactatcaaaatacttaaattagtataagtgtatttaaaacaaaaggatacaaaattccatcagcatctttatcctcatacactaatgccaggctatttaaaccccaacatggaacctgtatgtaatgttacataccactcacactcttcatataaaattacagggaaacaggggaagtaaaccagtaaaataaaatataaaagataatggctccatagctggtccgaagtattggggttgttatcagagctttcttccaatatgcatttcatattccttttgagagtgtttacaataatttagattgcactatttattgacttttaacattttagagacacatttaccatgaggaacattgcaatcagaagttatgagaataaactttcatttatcaaacacaaaaagtagacattttatttttatgagaaacaacagagatgagatatccatttaagtggaagcaaaaactgaaagttgctagtatttgaaagcatcatttactttttgcttttggacagacatttccttcaacaaatctttactgagtttcatatctatgcaggaaactcatatttgttaggaatggacaaaatacctatcttcaatttcaagtagcttagagactattagagacataaatacaaaaataattagaatataagaaatccattataattagatttatatacattcctgagggagtaaggagaggatacaaattgacctgcagtcattgggaacagtgtcctcgcagaacacacagcctaagagttgagacttgaaaaattcattcattaatttacgaaatatacaattattgagtacctggatactacggatggagaggcaaggaagaccaacacagccccttgctatcttggagtttatatggatggcgggtgagggccacagataatacatatagctcaacaggccattagttggttataatgtgatcatactatgaaatgagagcaattgaattgagtctgtaaaggggggcctttagtgcagtactggacaactgtgaagactgaagtcagaagtagtgaaaaagaaggtataaactctttctagacggaaagaaagacctgtgaaaggccctgtcacatcacagaggaaccggaaatccagtgcagcttgatcgcacaaggtgcaggatggttgtacagtatcatagcctaccttaatctgtgggtccacagagatttcttgagctctgccccaaatctgaaatttgaacacccagtaatctttcatgttctatcgtggtttcattttacaaacttggactcagagattgaccaataagaagagatgtacacataagtgttttatcttctttttttttttttctcttaatagagacaaggtctcattatgttgcccaggctggtcttcaactccttagctcaagcaatcctctccccttggcctcccaaaagtgctgggattataggcgcgagtccccgaacccagccaggtgttttctctttataagtgggatacagaaacatctggttggggatttttggggtagggaccagaatggctgggtgtgtgcaaacgggatggctcaatattttaatgactggtacagtcacatcaatgtctcccagccaaatagagccctgctttttctctcttcattagtggttctgaaagtgtggttactggaccctggaccaacagcatcagcccatcccctagaaacttgctagaagtgcaaattcaaaacttgctagaagtgtgtgcaagactcacacttactgaatcagaaactctgggatgaggtctagaaatgtgtattttaacaggacttccaggtgactgatgcatactcacacttgaaaattactgctctaggtaactttattctacaaacacaactcacccaaattctgcagagaccaagatattaacattaataggaggacaactgccaatccccaggagattactatgaattattttgacatgagacttttacattctcttcctgacttcacctccacttacagagagaagtgtgactgccaactgccaaagaatgggttctacctgaggctccaaaaagcaggatttcatgtgtctgaagcatgaaattaacctcagaacaagtttgaaaacagaagaacctaaggattgtggaggtgtgatactaataagcacgaaaacaaaaagcattcatcccattgttggaaaggattctgagatgttttaattgagaaaatatttcttttccttactacaggccttgactagatattagcaaatagtagtccatatgctggatttggtctcatactaattgaaaataaattgaaatttttgccagtagttaaaatttgagatattagctacaaatatcaaatctgaccactcttgatcatatttaataggattcagcaaccctaaaccttccttcctataggacaaaattgagtatcaattatacttcacatccaattatacttcgcatccaattatacttcatatacaaagtataagctctccagtttgctgtagtcctcatcactccctatccttttttatacgcaactcatctcacttccttatgttatgtttctggcttctacaataggcatttggatttggtgccccccggggtcttgatcacagcttctcaaacttaaatatggatacagcccacctggtgattctgatttaaattcacggggttgggtcgaagaattcagttctaaccagcttccaggtgaaaccaatgttgctgggtcatggatcacactttgaatgacaacattccaggtaagaatattatttatttgaaaaccactgctagtctacttaaggtatgtgttcgatctattagttactactgctaaaactcagaagatatagatttatgtgacactggcagggaagtatcaaagggtatcagactcagaatgcccaagtatgcccttcagtaaagtaaggaagggctttattacagtactgatatgtgaaaaactctaaagattgaaataactagtaatgaagaggacgcttccttccttcactgaggcctgtgaaaagagcatcagtaaagtgcaggtgaattataggccagagttttctgggtgattagcaaggaagtgagtagtggtccattgcaaggctgaaccagaggaagaagcaaaattgaaggaggcactgatatcagaaggtgagtttaacagccttcatgacacaaatgtcctttttcccaaagatggtttaaataaaggggtgacttcagggagtggggaggttaacctctgggttaaaatgtcattaatattagttgtaaaatacactggctaacatttattcaactttttttaacataaccttgccaaggtaaagatttataatactagtatttttttttttttttttgagacagggtctcattctgttacccaggctcgagtacagtgacacaatcataactcactgaagccttgacctcccaggcccaaatgatcctcctgcctcagcctcctgagtagctgagactacaggtgcaccaccttccctggcaaatttttaactctttttgtatagatgtggtctccctatgttgcccaggctagtcttgaactcctggtctccagctatcctcctgcctcgacctcccaaagttctgggattacaggcgtgagccaccgcacctagctactgttattttatttctgaggatagtggtaggttaaagagctggcacagtggcatgtgaagccagtatagaaatcacaaaccctgtgtgacccaagactgtgcactattttatttttttcatgggcaaaatattgtattagatcatatgaaatttctgatatttcaatttctttgttgatgaaaatggcttcatatagttcaatttaaaacatgatgaaaatgagacaggagtttcttatttccagctaacattctaaagatgtaaataaatttggaaaaattgtcaaagtcacaaaataaaaatctaccatgcacagataggaaaaaatgtttgcatttttccaggtttcattttatatccttcaagtcgtcatttagacgggaaagtaaaagcaaaaggtgaatggagtatacatatatgactggcaatagagagccgagggagtggaattagaataaagtagtatagggcaggagttggtcctgacagtaggtataggcaaaagcatatcaggacatgatactaggaactgctacggtaaacttccaatcgttcagatcatctgagaatagagaggggctagcaaaacagataagttgtaagaacttggaactttggcaacatagagttacagacctaatggtctctagcgtcaacgacatttttgatatattgttagataacagacatccttatgattgtgcccagtgtttctcaaactttaatgtacatatgaatcacctggagagtgtcaaactatgcattctaagtcagtaggcctgggttggggcctgagattctgcatttctaacaactgcccaagggatatcaatgcttcggatccattaatcacattttaaggagcaatggtataagtcactttgagttggcctttttgtcatttgcagtaaatggcattctaagacgtagtatttttcaaatgattttactcgagagctgtcatcccacccccggacatgaaaacgtatctgtatgaacataaaggaattcaatgggaatgccagctttgctttacagaaactctgttagaatgtaggaaggcggctgggtgcgatggctcacgcctgtaatctcatcactttgggaggctgaggcggcggatcacaaggtcaggagttcgaaagcatcctggccaacatggtgaaaccccatctccactaaaaatacaaaaattagccgggagtggtggcacatgcctgtagtcccagctactcaggaggctgaggcaggacaattgcttgaacccgggaggcggaggttgcagtgagctgagttcgcaccattagactccagcctgagtgacagagtgaaacgccgtttcaaaaaacaaaaaagaaagaatgtaggaaggcaattattctttaaccagtgttgtccagaacttactaaaatgatgtaaatattctatgtgtgcactataggtatacatatataatggacactagtcaggtgggaataatgaacacttgaaatatgtatggctagtaaggctcagaaactgaatttttaactatatttaattataataattataatttacctacacatagctagcggctgcaatattggacagcacagctataaaccgacagataattagattaccaatatccgtgaatccttatttgcaagtacttatccataccaatttattttgtcctccaatgtctatgaggaatgacatcctaagtttagcaatctagcaataaacattaatagcattttttaaaattttcattttccatatacaaatttataaatgcaaaatagtacatgttttcattaatttcagcctgtatttgatggtcctaatagcattttttgtgctttatggaaatacattataaaatgtataaacatatattatgaaaacataatcatatgctaggcactaactaataaaggcataaatggatagactttataaaacctagaggactacaattaaaacttacaaattaccaagaggtgtgagctctttaggaagacaggctctcaggcccaattccctagaattcacagttactggcatatatgcaatcctcaatttaaaaaaatacacctaataaaaggaggtaatgtattataatgaaagtctagattagaaaagaactaccagtgatgttcaattgacatgtcttacatgtaaaatacaattacatgatttaagtcagaaataaaacctgtataatatgatttaagggaaagataccagtacaaattagagaaacttaatttttaatgcatgtttttacttttaaatgcacgccatttagaaactaaaattgtactgatgaaaattggaattgatttatttacttattcaaaatgatggctcaggctgggcacagtggctcaggcctgtaatcccagcattttgggaggccgaggtggctggatcacctgaggtcaggagttcaagaccagcctggccaatagaaaccccatctctactaaaaatacaaaaattagctgggcgtggtggcaagcactttttaatcccggctactcaggaggctgaggcaggagaatcacttgaacccggggggacagaggttgcagtgagctgagatcacaccacttcactccagcctgggtgaaagaacaaaactccgtcttaaaaaaatagataaaaataacaaaacgatggctcaaaaattctagcaaggtggttcttatagatagattagttttggttttagcttaacaattctttatatgcaactagatgcttctagaatgctgtcatctgcttaaataagtaatttttaaaatcaactttgtttcagcttttgtttcattctctattaagaaaggtattgggggctggggaaggaatagcattaggagaaatacctaatgtaaatgagctgatgggtgcagcaaaccaacatggcacatgtatacctatgtatcaaacctgcgagttgtgcacatgcatcctagaaattaaagtataataataataataaaagagggagagaaaaaagaaaagaaatccaagataggttaaaaaacagaaagttattaattgaggtaatgtttaagtccggcttttattcaaactatcacagataggtgaattagtggaatttatataaataatgccttaatataaaaaggtactaattgattagaatcactgagagaacttttcaaaatgacgtcccagccccattccccaacaattcaatcagaatatctgggaatggagcccaggtattggttctgtaaaaaactatccaaccaggtaattcgaatgaacatccagggttgagaacgattgtgcctcttccccgcccccccccccgccccaggacacagccataatttttactttagcccttgggtcctcacaagtggcaaatacctggaaagctgtatccagacaacatgacttgttagggttaacatgaaccagatgcacagaggtaacatggagacaaaggatcaggatgcacaaacatgcgtttacttatttataaatgacttccacaagtactaaaatatctattatgtacccccagaaattacaaataaaaaagaagacttactaaagagtaattttgatcttgtagaatttggggcttttaaatataatttttaaatacaaaataataattgtgtgtcagaaaaaaagaggtattattgtaattaatcctattgattcagcaactgatattagccccaatttacaggtggggaaacaaaggcttacttgggtcaaaacgcaaacaagggaaggtgacaaagtgggaactcaggtagtttggctccggggcctgcttcacaatcatgcaatattgcctgaactaaaattaactttttagagattaactttatatctattataaagtcatttatggcactgattataaatattaaaaaaatagaaaacagaagttcatttggtggaattttatacagagattgtcattaataattttattattttcaccaaaacgaaaattacagttgttactcttgagacaattgttcttagcatgatgtttactttaatgatagaaaccacaataccctattttttaaatttttatttttttgggtatatagtatgtgtttatatttatgggatacaagagacatattcatacaggcatacaggcataatatgacattagggttaatagggtatccatcacctcgagcacttatcatttctttatgtgacaaacattccaattatactttttgttattttaaaacgtacaacaaattatgtttgacagtaatcatcctgtcgtgctatcaaatactacatcacattcattcaatctaactatatttttgtacccattaatgatccccactgcccccgacccactagcattcccatcctctggtaaccatcattctagtctctatctccatgagttcagttgttttaatttttttttttttttttttttttttttttttttttttaagctctcacaagtaagtgagaacatgcaaagtttgtttttctgtgccgggcttattttaatcaacataacgtcctccagttccatccatgttgttgtaagtgactggatctcattctttcttagtcaagcttaagacttgtcatttttgtcaaccctttcaaaaaaaccttctttttgttttgttgatcttttgtatcattttgttgtactttaatgtatttcagctctgttccttactgtaatatttattttctcatactaattttgggtttggtttgctccttcttttctagctctttaaggtgtatcattcaattatttgaaagttcttctgcttttttgatgtaggtatttatacctataaactttcctcatagtactgctttcactgcttcccataggttttggttacattgcgtttcctttttcattcgtttcaagaaattctatagtttccttcttaacttcttctttgacccactgataattcaagagcatattgtttaatttccatgtgtctctatagtttccaaaattcttcctactgatatcttgatatattcagttgtgatcagaaaagctaatttatgttattttgatttttgaattttctaagacttgtttcgtggcagaacatatggcttgtccttgaaaattatccatgtgctgagaagaagaatatgtactctgcagctgttggataaaatgttctgtaaatatctattagttcaaattggtctacactgcataataagtctgatgtttctttgttgattttatgtctggatgatctatctggccactgctgaaaatggggaattgaaatcaccggctattactgttttggggtctatctctctaactctaataatatttgatttatacgtctgggtgttccaatgttgggtacatatttatttacaattgttatgtcctcttgctgaattgacccctttatcattctacaatgaccggcgttgtccctttttatagtttttgtcttgaaacctattttgtctgataaaagaatagctaatcctgttcttttttggtttcgattggcatggaatacttgttccatccctttattttcagtctatctttatctttattggtcaagtgtgtttcttgtaagtaacagattattgtgtcttgtatattcttttatccattctgtcactcaatgtatttagattggatagtttagtcaatttacattccatgttatcattggtacgttaaggacttaaacacttcccattttgctatttcctttctggttgttttgtggccttctcttcattctctctttccttcctgtcttactattaatgaaagtaattttctctggtcatatgttatacattcttattaatttttatgtacctgagtacattatttgatttgtggtaactatgaggtttgtaaagaataagttataatccattatttgaaattcatgacaacactggttgcataaacaaataagcaaagagaaaactaaaaaaaaaaaaaatgctacactttaacttcatccccccactctttttgttgtttctatttatatcttattatagtgtctatgtcttgaaaagttgttgcagttatttttgataggttcgtcttttagtctttttactcaagatatgggtagttgagacatcataatcacagtgttataatattctctttgtaacagaatagtaacaaaccttactatcaccagtgagttttgttacttcagatgatgactcattgctcattaacatccttttctttaagattgaagaacgccctttaccatttcttgtagaaaaggtttggtgttaatgaaatctgtcagcttttctttgtcttagaaagtcttcatttctccttcaagtatgaagaggattttcatagatatactattctagaataaaagtcttttccttcagcactttaaatgtatcatgccactctcctggcctggaagttttccactgaaaattgtgctgccagacatactggagctatttctatgtgatttttttttttatatgattaccgcttttaagatcttttctttatccttgacctttggaagtttgatttttaaatgccctgaggtagtcttatttatattatatctccttggtgttctattatcttcttgtacttgaattttaatctctctctctaggtgggggaagttctgtgttattaccctcttcaataaactttttaggacttttttgtctcctctgactgtatttacaaatagcttgtcttcaagctaattctttctcctgcttgatcaattcttctgttactcgtctctgacgcattcttcagtatgtcagttaaatctttcaactccagaatttttgttcgattctttttatttcaatccctttgttaaatttatgtgtaggattctgaattccttctctgtactatcttggattttattgagcatcctcaaatcagccatttggaattctctgtctgaaaggtcacatatctgtctctccaagattggtcagcgatgccttatttagttcagttggtgagatcatgttttcttggatggtcttgatgcttccggatgttcatcaatgtctgggcattgaagactttggtatttattgtagtctttgcagtatcggcttgtttgtatccatacttctcaggagggctttccaggtatttaaaggttcttgggtgttgtgatttattcctttggtcactgcagccatatatgcactggggtgcacccaagcccagtaatgctgtgactcttgcagactgttaaacgtactgccttggtgatctttgggaagattcaggaaaatcccctgtattacctggtagataatctttttctctttccttcccctcaacaaagagagtctctctctgtgatgagctgcctggagctaaaggagaggtgacacaagcacccctgtagctaccacgactaggattgtgttgggtcactcctaaagccagtacaacactgggtcttgatcaaggcccacactgaccactgactggctatcacctacattcactcagggcccaaggactctacaatcggcaggtggcaaatccaatgaagcttgtgtttttcacttcagggtagcaatttttccctggtgggtttgcaagatcctatatgtaagccagggcctggggtcatgtattaggccattctcacaatgctataaagaaatatctgatactgggtaatttatgaagaaaagaggcttaaatggctcatggttctgcaggttgtccctgagacatgatgctggcatctgctctgcttctgcggaggcctcaggagatttacaatcatggcaaattgcgaaggaggagcagtcatgtcacacggccagggaagaggtgagtgggagggtaccacacacttttaaccaactggatctgacaagaattcacccactatcatgaaaacagcactaagaggatagtgctaaaccattcatgagaaattcaacgccatgattcattcggctcccacccaggccccacctctgacagtgaggattgtaattcaatgtgagatctgggcaagaacatacatccaaaccatactattccatcctggcccctcccaaatctcaagtccttctcacatttaaacatacaatcatgtcttccaaacagtcccccaaggtctttacttattccagaattaactcaaaagtccggagtctcatctgagacaaggtaagtttcttctacctatgagcccgtaaaatcaaaaaccaattagttacttccaagatacaatgggattataagcattgagtcaacactcctattccaaaagggtgaaattggtcaaaagaaaggtctcatgcaagtctgaaacccagcagggtagtcattaaatcttaaaactccaaaattatctgctttgactccatgtcctacatccagggtaaactggtgggagtggtgtgctcccaaggccttgggcagactccaactttgtggctttctagggttcagcttccaaagctgctcttatggtctggtgctgagtgtgtgtttcatttccagatacaagggtcaagctgtcagtggatctaccattctggagtctggaggacagtggccctcttcttacaggtccactaggcaatgccccagtggggactacgtgtgggggatcaaagcccacattttccctctgcattgccccaggagaagttctctgtgagggttctgcccctggagcaggcttctgcctggaaacccaggcttttccatacaacctctaaaatctagatggatgttcccaagcctcaactcttgcactctgtgcacctgcaggcttatggcttgtacccgctggagctgtggcccaagctgtacttgggccactctgagccacagctggagctacagtggccaggacgctgggtgcgggggggaggggttggggcgggggcacagtgtacgaggttgaacagggcagctgggaccctgggcctggcccaggaaaccattctgtcctcttaggcctccggatctataatgggaggggctgccttttagatctctgaaatgccttccaggcctttttccccattgtcttggctatcagcacttgccttctttgtaggtatacaaatttttctagcaagtggttgctcagaagccttcttgagttctcctgaaaatgggcttttattttctaccacatatccatgttgcaaattttgaaaacctttatggtctgctttccttttaaatatacatgtataaatatgtaaaaaacctgcacgttctgcacatgtatctcagaacttaaagtacaataaaataaaataataaatattccatcttatttctttgctcctgcatcagagagtaggttgttagaagtggccacacaacgtcttgaacattttgctgcttagaaattcattccgtcagacacacgagatcatcactctcaagttcaaactttcacagatatctagagcatggacataatacagccaacttctttgctaagggataacaaacatgtcatttactccagttgccaataagttcattctttccatctgagacctcgacagcttggacttcactgtgcatatcagtatcagcactttggtaacaatcatttaaccagtctctaagacattccaaattttccctcatctgtcttcttctgagccctccaaactcatccaacttctgtctgttacccaatttcaaagcagcttctacattttcaagtatcttgacagcaaagccccacttcttggtaacaattttctgtactaggccactctcgcattgctatcaagaaatacctgagactgagtaatttataaagaaaagacgcttaattggctcacagttctacaggctgtacaggaaatatgatgctggcatctgctcagctgctggggaggcctcaggaaacttacaattatggcagaaggtgaaggaggaacaggtacatcacatggccacagcaggagcaagagtgagagggagggtgccacgcttttaaacaaccagatcttgcaagaatttactcactattgcaaggacagtagcaaccaattatgaaaaatttgcccccatgatccaatgagctcccactaggccctacctcaaacactgcagattactacaattcaacgtgagatttgagcaggcacacatgtccaaactatatcaactcaagaacctaagaaatctacctggtgctctattctactgtggctaagctggcaccccacccaaaagataaagtccttccctctcttctctcccctttccacaaacagagatgtctctcctcatggccacgacgactactgaaccaaagagagtactgtctgaggtccaatgttcactcaagggccaaggccactttggccagcctgtggtgaatgctgtcagtcctgagtctctcccttcagggcagtaagaaaatggaatccaggagccaaactctggaatcagggaccctaggagcccacttgatgctctgccccactgtggtcaaactggaacccaagctgcaagccaaagtcccctttactctcacctctcctttcctgaagcagaaggattctctccctgtagccaccacagctgggaatgtactgggtcacacctgaaaccatcacagctctgagtctcacccaatacccacagcaagtactgcctggctacagctgctgattattcagggccctaggtccctttggtcagcatgtcatgaattctgccaggacggggtccttctcttcaaggtgacaggctctcttctggcccagggtgtgttcagaaatgttatctgtgagctagggcctggaatggggacctcaagactctgcctggtgccctatcctattgtatgtctgagctggtatccaagcagcaagacaaagttctctttcttgtctcctctcttcttcataagcggaaggaaggagtctttcctggagctgtgagctgtgctgcctggggttgggggaagggaagcacaagcagtcccttagctgccccagcggatgtctcactaggttgtatgtatcccaagtccactgactctgagcccggcacagcaccaggacttgcaaaggaactgcagtccttgtggcctagactacctttgaagtttatttagaaccacagagcactctaatccatgatgacaaggcttgccggaactcaggttccaaacactgggatggatgattcttccctgtctagggttcatctaaatgctccctctgcgggatttggctgagttctgttctttgtcggtttccactgtgacagggcagcactgattttcaatgcaaagtcctataatcactgcaatctcccttctgcaagcacatagactctctcttcatgccatgtgactgctgccatggatgagggagagctggtataggtgatagaatattgcctttactaccctcttctgtgcctctttctgtgatacaacccaaaaaccaggtactacgatcatgcacctaatttttcactcttatgaaggtgcttttctagtgtggacagttgttcaatttgatgttcctgcaacagggataattactggaggcttctgtttggcgatttttctccacctcctccacaataaacttcgagactcattttccctcaaatatatggtgaccatataaaatgactagatatttttaaaatgtatggtgtatcattaaatataggaatcagaaatcatgatatattataatccaagaaatggcaaacatgttttaatatagaaaagcaacattcatttaaaagaaaagcttgagtagtgcatgtacaaacatatgcacatagttttttgttgttgttgcatggcaataatgaatggtccataggaagcatattagtatttttcaactcccaagatttataacgtttatcaaagttcaataagtggcctgtgaaatataagctttaaagccagaatccaaacagaaccaattaccccctcaaatgtgtaagacttcagctgtcactgttttcactatctcatcacctttaccacaagtacatccatcgctattgtcctctagttctcatgctaactttctgaatgggtaccctcagcatctgtgaagctgtagaaaccctactggcctagtttacctacttgcctcagtaactagatctgctttcctccaaattctggtattccttactagactcagctgcaaagcctgacactgcatggtgtcacggtgtgtataaatcttaggcactaatatagtagtttccattggagaatgaagtgaggcaaggtctgacaaaattatacagtttttatccccctaaaactaatgtgttcattctcctctttacagcaccttctttcccaacacgaagtatgctgacatcttgggctaggaaagaagccaaggagagcatgtcatgtatcattttcaaaaattcccactaattgccatagttattatactgcaccctgcaacctgatcttggaggtcaaactttaaattacaacctcacagtaaatagttcagaaagaacctaatataaagttccccatccaacaactagaaatgaaggaaaatgttccagtttttcacaaaattaaacatgcactaacatttattttcctacttaatggaatgtgagaaatagtattgtttttatactgaattctatgagaaaatcgaaaatgtgtcattgttttcaaatcctgatccatttttgtcctccatccatatagctgaacagtttaattattaatatttttcaactatccgaggcaacattaaagttcaaatgcaaacacatttattttcattttgaaaacataaattcagtttagtaacaataacataaagaagctgcgtggctggatgcaaaagattcttggccaggcgtggtggctcatgcctgtaatcccagcactgaggctgaggaggctaaggcaggtggatcacgaggtcaggaggtcgagaccatcctgaataacatggtgaaaccccgtctctactaaaaatacaaaaagttagccgagcgtggtggcgggcacctgtagtcccaactactggggaggctgaaccaggagaatggcgtgaacccggggggcggagcttgcagtgagccgagatagcgccactgcactccagcctgggagacagggagactctgtctcaaaaaaaaaagaaaaagaaaaagaaaaagattcttgtggcaaatacattatggcaaccctcaaatcaatcttcctgattaaatgcttttaaagaaaataaagaaattggcagatgtcatcaggagccaaggacaaatatgaatatatcacgtttggaagactgtttaaattatctctagtaagaataggtaatgttgacactctgaaattctattcatttatgtggaaatagaagctcactctcaacttcaaaaattttgccactacatagcatctggcacagtgcctggcacatactacacactcaataaatatttcttcaatgtataagtagtataacttaattatgaacaagacatagttttgatatttctgattgggaatttttgtactaagattaaaatgtcaacttctattaaatctgctctctgagatagtctattagtttaatttgaattgttccaacccctggctgttacccagttccaaagtcacttccacgtgttcgggtatctttatagcagcaccccactctctgcggtaccaatgtactgtactagtctgttctcacgctgctaattaaagacataatagagactggataatttataaagaaaacaagtttaattgactcacagttcggcatggctggggaggcctcagaaaaaatcatgatggaaggggaagcaaacatgtccttcttcacatggcagcaggaagaagggccaagcaaaaggggaaaggccccttataaaaccatcagatcttgtgagaactcactcactatcatgagaacagcatgagggttacactcccatgattcaattaccttccaccaggtccctcccacaacacatggggattatgagaactacaattcaagatgagccaaaccatatcagcattatttatctttgtgagaaagcattgtttttgaagatacggctctctcatttctgtgaattccagaaatttagctttcctgtaatttaaactatgagtcacatgcattgtattattagtacaagagatgtccacatttagctgcattatcacatttttaattattgacagaaaaattattatgaccataatccatgtgcaacctaaccgaatgtcacgttatcatctataaataattcctacttcttattagtccaatagcttaattatcaatactcatcaacactcatatattgtctgttatatattattgcaccagaatcttgctactgcttaatcacccatggggtatgatatcaacatatgaggactgaatgaaatatcagcaccatttttagagctcctgagaaagtaattaaaatatttggcccacgtcacttgatagaaaaataggaacagaagatatctaagtagaggtttacaaagaagttgagatttctactctgtcttaatttcagttagatcagtgcttctcaaacttaaactgatcagggatcacctgggatattgctaaactgcacaattctgattctgtatatatcagaatgagagctgagagtctgcatttttaacaagttctcaggtgacgctgatgctactggtcctacaccaccttgatctgcaagttactattgcttaacattactggaagaagtaaaacagaaaaatcaatgaacttaccaaattgtgaaataaaatcacaattaggagtttgagattgtgcacctccaaagtatttactgcaacgaattcaattccaagattggaattacctgaataacttaatttagttgttcatctattcattcatatattcacatacgcaaacttcactgcacttgggagaaaataacccactcatttgttcagcacctccttttctctatccactctcacatatgccatcttatttccagagtcaaatagacacttgggggaaaaaaaaagagatgagccatatttgttagatgtatttttctgtccagtcaaagcattgatggtgattcacaattattttccatattatggcttgtgtatctacccagatactattcatatctctcctcctgctgatataaaccaaaaaacacaacttcacttggcctcctgacttgctttcatttttttcccttaccgtcacagaagttttagtttctgcctgcatgtcctaactacaattatcagaaaagttgatggaacttgctgtgcttaactttgagtccttataaaaatgtcagtaaatcttttttgctctctgcaggttgcatttttcaatcaaattaattagtttattcatagagaagaaaatcttctgttttccctgtgccagttgtcttcttgcacttccacagttggaagttgtgtgtttttcttccgaattccttacctcctaccatcccaagtgtattccacagcattaaaaaaaaaatcattggcttactcctcttaaggggttctaacaaaaccacatcaatattctcttgttttaaacactacattatgaaaggaatggcacttagttttctcatttaaatcatataaacattggtaaagttttgtaattgaccagtatcggcacgtgccaaactcatttgtgactggagatgtgttaataaacttctttattgtattagcttttacctcatcagaaatttatgtccataaaagcaacagaattggagggaaaatacaatagcaaggaaagaatcaaatgagagtgtggttatgaaggagaaagaaaggaggaagtatctgtatggttatctttcctgacattcctttgtaagcatatttttaaatgttgccattgtgaaaaaataactgcaaatgtatttctaatcatcctgctcatgctcccttatccccatacaaaataaccacagctatactctttgggaaaaaaaaatgactgaggcaattagaaaaggctggagaaaaaaagtaaaaaacatctatgagggtcaggtttggtagctcaggtctgtaatactagtactttgggaggccaaggtgggagaggatcacttgaggccaggagcttgagactagcctgggaaacataacaagacctcattccctgcaaaatttttttaaaagttaaaaaattatatataagttattatacaaaatatatgaaatataattatatataaaattatataatacttcatatagaaaatatcaaattacatataaaaagtgacatggtatggtaaaatagttaactgacagctcatcatcttatttatcacagttatctttcttcacattttataataattttgcattcacaaactaactttttataccctatctcatctagtatctttcagaggtatgtcagcctcatgacactattgctgttttacaaaactataaagtagagaacagaaaagaaaagtatattgccccagttcacataaataagtgtttgagaaagcaagcccttattccttaggcaaactggagaggattttatgtaaggcagaaatcagggcacgctattatctttgtatttttaatatttcttgttttgcataattgttgatggtttatgggataaatattatttcctagatgcaacttgaataatagtaactgtgggcacaaattgaagcagtctatttccaaaggaaaaagcacttttactgtcaaaaggaaaaaaaaataggaactaaaactaaacagagaagtggtttttaaaataactaaatggctaagatagtaaagtatacttttatcacaactaccagctggtctaagacactactgtgtcttaactggccaacttcactggcctaataactgtcctctcttcctccagtggccttcctgataggttttcttgacctatctctcacctacataaaatctgatggctttgtcttgcacttagtctagaattcaaagcccttattcaaagccctgactgacactacaatatgtaatcagtctcctacctatatttcaaccccatctcagacctcagccatctaacttaccaccctgcaactctacagtccccctggccttttggttcctccagcaagccaaactgtccctatttttgggcctttgcattagctgttcctaatccgtgaaccacacttccttgtgatctgcaaatagtggtaccttcttgtcattcaaatctcaaactaaatggtaccaaccttcaaagtcttacctggatcacaaagtctaaagtagcctcccctcaaccattctctatcacattacattttaatctcttcaaaaactatattcctatccggtatttttcttgtgttcttttttttcttggctgccagcctctacagaatatgtttcatgagatctggggccagaccttgtatgatcattattgagtctccagtgccattaattgtttttgataatgtattccattaatatttgttcatatagagagatatatgtgtattttatacgtatatatatatatatatatatatatatatctcacaatgactatatatcaaatataatttgatgttgctattaggttggtacaaaagtaattacagtttttcccattacttacaatggaaaaaaacatgattacttttgcagcaacctaatagtaagtatgttggtagataggattaataattgctaagtgtaaatgttcatagattttagtgataagcttatctgtatttacaagaagtttttaacttttgttatatcaacttagaaattatagcatagctttggatatacttaatatgactagacaaatgttaattatcatttctctaatcgctaaaccaaggcttaggcaggaaataatggcttccgactggatctatccaaaccctgtcttaggtagagagagaaaagaagtatcgatgaatccatttttgtttactagtaatcttctactctgaagtaatcatatatttagaaaaaaaataggtaatgctccaagttgaagctaatcattggagataatccattctcatgaccatgataatggaaactgaacaggttataatttatttgaagcattaagtaaaacctagattagttttttaaaaataatgacaataccctcttttcataatcacgttttttgtttcctctcacaaaatctttcaaaaatcaggttcagcaaagcttacataatggcttatcacattagaatttaataggttttatgcacgaacacatacatagtcaaagtggcaaggaagactgttatttataaactctcatattatttctgaatttgtgttgctcaaataatgctttgtatattcatttttaaggaattttccagaaaagtctatgtgatagaagtggttacatgtacgtgtctcattttaaaaactctgtgagatgttttagcaaaagctataccagctagaaggctctccttgccttcttaataattattctaaaagctgtaacacgtacaaaagctcttgaatcttccctaaggacaaactaattttttatgtcaatctcagctaggtggtaatactgccattttagcatttccattctctagtgggatggggatgaggaaattacacgcacagaagtctaggtgtctgtcatccttcacttaatggcagacatcccttgaaggggggaatttttgaatgaacatctttttaaatgttagaatcacagataaaagactttttttatgtttcagataagcaaagaaaaagttgcaattttaattccaggaggaattcatattttcttgcaactcaatttcacacagcaattaattaactgattagtatgaataattaatgccatattgttagttttattgaaaatggggagtgtaagaaaaatgagagcatttagcctccaggagaggatggaaacctagagtgcacaaaggagaagacactggtggctattatggcaaggacagtaaagaggtggttggattttcaaaactttctaattttgtttgaggttgctttaagttccacagatcactgcaaatagaagttctaacctgaagaatgttggcatatgaccacagaaggcagcttatatcttaatatcgataatagatggagtaaattagtggacctggtaaacactggggagtgggcagactcaacagttataatatgattattgtacctctcacatctaggggtagtgacaatcatcaccacgatcacagcaggcgaataatatcaatatgcatagattagtatctcctggcttggaatacatatatagttatgaaacctctatcttacatgtaccttatttattctttcaaaaggcctgagcttaaaaatgtgtttttcccctccataatttcacactataatttagtactggaataccaatccttctagcatatctaatgagtttccttggtccttttttttttttaacgcttttgaacttcataaataatagttaaataaacttaaggcatttggacaatttttttcacttaatgtattcaaatccacagttggcacttcatttcttttcatttaaaaataaatctatcttgtcttgataggctttacatgaatatacacacctaacaatataaatcaaaacacatatccagaatgatgagatctgcttgttacctttataagaaatatgtcatttttcagaaatgtctcaaatcctcttttttattaagtcaatatatattcttaagataattcatagccatactgtattttaataagaatttcccaaaacgtttgaataatgtttttcaagaggatttccatatatagatgagtaactctttaatattttcaagggctttttcttcagaagagaagtttcgtgtcaactatagctaataggtgattttatgtacacaatctcctgtgcatgcttctgtgccttttatagtgacattttaatgtttggaggaaaacctagaaaataataactatgacagaattttggcaaatcttaaaacatagttctgtagataacagtgcatctatctaacatctgctcttttagttacaaaagtgaaaaccaaaatgttatttctatgaaaatccaaccagtctcccttgaaagaaagctgtgtgccttgggaacaaactgagaatcgtaacttaaccatcaaaccacatcaaaataatcacaagcttccaaaacttgttagtcttcttaattaaaaacaaataaggacttacttgctttgtttttccatgctagctaccctgaggcattcccatcttgaatttaggagattcatctgctcttgtacttcagtttcttcatcttctgataattttcctgttccaatcagcttacttcccaattgtagaatattaccaacccggccctgatgggctgtcaaatccatcatgtacccctgacaaagaaggaagttaacaattgtaattagaactctaggtaaatcggtgtggttttgagttttatttgtttgcagttttaaacttgtggcccatttagatttatattcccagtaaaaggaatttaatttgtatttgcagaatcccaaaaccacttttaatatgaattaaggaaaattatcttaagtcaagttcttcagaagcaggccccgagataaggacttcagtgcaagtgatttattaaggaagagctcccaggaagttccgcaagggagttgaagatggaggaaaaaggacagggaagggaaagaagccaaacgagtgtatcatctcaggaaaagtctcccactgagagaagttaagcccaataccatacatcaactcaggaatgtaagtaatgcctcagcactgccttgacacaagagaaagaagttgggctttcgtattcctgttggccgatcaggtagaaatgccttcaatggttgctctccaaaagaaaacttcaaaatctgactgttggaatcccaagcacatcatagtaactaaatttccaaaatacaaggatgtaagagagtaattgaggaaaaaggatgacttgccattataacaagtcatatgttttgttttgtaaattaacgttttagtttacctcatgagtatgaaactggtctttcaccacttccacatcattagaaatctctccttgtgcttgcaatgtgtcctcagcagaaagaagccacgataatacttcttctaaagctgtttgataacggtccaggtttacttcactctccatcaatgaactgccaaatgacttgtcttcaggagcttccaaatgctgcacaataaaataaattgggtgttacacaattaatgtctttgcagattgttccagtacattaaatgatgaatcgaatgaaatatttaaaatgctaggactgtccactggcattatcaaacacaggaacagcagatacagacaatagggagttttcattttaacttcctcatgcatacatcaattttcaaatagcggtcaaaatccacaccaaattaatattgtattaaagctcttctagattactggaaggagtaaattagtatatcacctcatgttgctttttaaatgctataaatattgatctgtaggaactttcctcatttcttatttataataacttacatatacattatcagaattatatttacatacctctgcaatggcattaaaggaaatatctcttcctgagaggccctaggtaatgaaatatttccaaatatttacagaccagtaaaggcatcagtaagaaaacaaggaggtaggggaaaggaaggcaaaatttagaaagaaaaaaaatacctcacccacccatctaaaatttctaacagcataatgacttctgtgatttagcctttatttccagaaggccacgatttaaatagtaagacattatcttagaagaactaaaatatgaagtatgctttacccaatttaattagcaggatattaagtgagaatgcaaatggttgtcttggaatttccgtctggaccctaaagccaagagcaaagtgtacgaagcatccataattctaaagagaagatccagggtacctgttaaaaaattgctaagaagtgatcacaaaattggtctcacaacccttaatccaatatctagcttaaaggtgtgtaagagcaagcaaggaggtcgattagaaaaatctggtgagaaaggcttcctctggagaggctggagcgctctgcgtggctctaacttctccccatctgaagccaagtaatagagacggggtagtttacatgagctgtaaacctggccatatgtttgcagagatttgcatgctataggaaccatacactcaagtgacaggagaggcttcttgggataaactacatgtctgctgctttaacctaaaggcatttatcaagggcaaaaatttgagtaaactactaagtttgcaggaggttttgctttgggaggagtgtactccttgcaggtcgccgggcttcaaaaatcctgagaacatgctcaagagggactttgctgaggtcaaggacataggcatactatttacggaggtgagcagaacaaacaaatattggagaaatatttgtagaagaatcttctgcattccacaaatattgcaagcaagcacggggccccctaacaaacagggttttgtaaaggaatcaaaaagcagtgtagaacaacagaagctgtttgggggatttcataatctcacccagagaaaattcaacctttggtggctttcccctggtgtgtatgtgctacatttcctgtccttctcagttctgggaattaacccactaagctgccagcaccaacttacttgtgctcttctgataaatgctcaaattttgaaaattcaatattttaaatttccccaactgttaagtccttcgagatgacaaggcatagtggcagttattgcaatgacattttcatcaaatgatgcactctttttccagtttctataaaagtggcagagaaaggtcatcctggtaagtcaaaatcaccgaacttcatcatatcaaagagggtaagtgcactgaaagggctatttgcatggaacccttgtctaacagtaaggcaatttctgaaggtcttaggggttagaacaacttccatggtgtatctcttccgtctctaaatactattaataataactatcaaagtcagcattaagggggaaaatgatataaaggcagcctgagagatgtgcgcaggtggaaccagcttcacgtttgtgcaacctgagcagttgcacagggccctgagcgcagaagaaacacatgcctctattatctgctgatactatcctgaaattgtaaataattttatttttgaatttgtgttttagaagtgaagtcctatgtgcaatgaaggatgcacatgcgcagaggagacaggtggtataatatgtgtatctgtcctatttgcatatagcattttcaatgccctagaagcacagaagtctggtgagctcacagtaagtttagtaagattcaaagaatatggcgtaagtgtgttatgtctataactgagtaaacaaggttgctggcagccctgggagataatgcttcctatctgaaccagaccctgcttcaaatgcagcaagaaggcaattttttcaagaaaatacaaacgaccaagaaaccctatcatatcctttcctactcctgttatgttcctatatgaaccaaccacttatgctgaaattgatgatatagaaagaaagggaatcttgtgactttgggagttacctagccctgcataagccttagtttctgcttctgtaaaatgggaacaataatacttccataataagattgtggtaagaattaaagagtgcataatgcacttcacagagtgaccttgtataacaactaaataaagtatgttacggctgtaattattatcaaattcctctgcatatataagaagtgttttgaagcataaattgccccaagattaccttcttaagtcactgttcaggtttcaggagatggaaaattattgtcgaaaatacgcccccaaaaatgtgtaagagcaaacattatttaactctttttgaaatctgaaccttaacctagctcgtatttaagagttcttaaaaatcattaactatcttgagttcaaataatcttctccaaacgaagcattgtaaacagcactaatactcaagtaacacaatactttacactgtgcaatttgaatcaaaatattaaacactttatgatttattgatatttacacaggattgaattttggaagaaaatattaaaaggtgtatacttatactcaaggacatgacatctagtactcaaattctgaacctaaatattttgtctgaggatgtgcataaaacaaaaacatttcaaagacagccttcttaaagataaattcaaatctgaataagctatgcaaaattttatatttatatccatcaattcaactatatatatacagaattataatcaaaatttgaatttaagatctgagtaattatttgtctagatagactattgtttttcaaattgtaagtcagaatccattcatggttcataaaatcatgttagtaggttatgactaggaatattttaaaattaaacagaaaaatagtagtctgtgtcacttatataatactaacaattattgtctcaatttttgtttcagatgtgcatatgggtttattttgatatgtatatgtatatatgttctaaggtgagattaaacttttttctgcagtttgtaaaacaaaattggaaatggctctagaatttcagactaagcaaaccgacgaaaaaagaaatttgcctgaattctacatttgtatattttccatagagaccttggaataaaagacattttaaaataaaacgatgtttaatctgagaatttggaaataaagatataaaaagtggcttatgctttgtttcagcaccccaaaatatgtttttatcatcacagaattttacattgtacctaagattggagatcacttcatacatgtcatggcatcaaatgaagagattttctaggaaagttggtttttgttctttatagatctatttataagaaagatagaccccaatcgtttcatgaatgaagatgccagtatcatcaactggaactaattatttttcctatgcttcaatcctattttgtctttatcacagtagtttatgtttctcttcagtacattgggcaaataatgattacgatgagaggcatgacagtgaatggatgaaacgattctgtttttgttttttttttttcccccaaaattgagtacactcaaatttattcaacgttatccacagacttcagaggcttaattactgcctgttagatttaggaagtattagatattgtcacctatgttccttgaagacatcgctcattaaaaaaggtggaagaggccgggtgcggtggctcagacctgtaatcccagcactttgggaggctgaggcaggcggatcacgaggtcaggagatcgagaccatcttcgctaacatggttaaaccccgtctctactaaaaatacaaaaaattagccgggcgcggtggcggcgcctgtagtcccagttactcgggaggctgaggtaggaggagaaaggcgtgaacccgggaggcggagcttgcagtgagccgagaaagcgccactgcactccggcctgggcaaaacagcaagactccgtctcttttaaaaaaaaaaaaaaaaaaaaaaaaggtgaaagagcagaaaggagaaaggtaaaaaaatcagggatgataaatgactgttttagtccagcaatgtctagaaaaatctctagacactcatttctggagacaatttctagtcataatttctactcgtagaatttctctgactagaaatggttctaatgaagtatacagcaatagccttgatacttctgaatatataaatatattttaaaatccagtttactatctgtctgatcttgggtatttaacctctctgcatctcagttaccccatctataaaacaagaaaaataaaaatatacgtacgtaaggctgctggaaagattagatgagatagtgcatataaaatgctaagcacattctagatcccaagaaatgctctgcaatgcctgtgtttgggggccaaagttcattgaaatgataaatgatttttatggggaaacaggtgaatgagctctgtgtgtttctggaagcatgatttgggcaattcaaactgagataagtaatcaagtggctacatgtaggtagtgaaaccagcagcccagcaaaccacaaagctcttagaaaaaatagctgggacactatgagagggcacagtctatcactgagcagttttatatcactgataaaatggattttggcaatttatctaaattcagccttaaagtatgatacgactgttaacctggatcaaaaacagttttattggtcttgaatgcataaatgcttcaagaacatttgcaaattttatcattctcagttcatttaaatgtatcatacttctttttcatggagtctaagtcaatgcatggatggtgaattttttggtgtattctataatctttttacccctcagtaaaagattatttccaagataaaggattacagagggataaccaagcggttctttcactaaataacagaagagcatttctgaacaaccaggattagtacctggaaatattcttgacacatttccgctgtgttttctcacagatataacacgtaaaccaaggtactattcaaagcataaaaatgattactgaagtgatttatgagaaattaatccatcatgcaacactgtacatgacattcaacctaatgacactattaaataggtaatttttaatatagatagggcctgaaattgagttcaaagttaagccctaatgaggatttaggaaaaatcatggcctgctgttagggcaacaatcaacaacaaatacaactactaccgcatatacaacagcaataacaacagctgccattatttattgagtacttagtgtcagtcaatttgctaatcacttaacacgcattatatcatttttcactacaacagatcagggtgatagaaattagtaggatgaggaaatggaaatagaaaaattagatgacttgccaaaggtcacaaaggtaactggtggttctgggacttaaaaccaggttgtttggattccaaaacacgtctttatcccaatatgatcaatctctttaaatgaagaaaatgaattaagagtctaagcaacagcacttttaaaaaaatataatataactttttttttttctgtttttttgagattgagtattgctcttcctgcccaggctggagtgcaatggtgggatctcggctcactgcagcctctcccttctgggttcaagccattctcctgcctcagcctcccgagtagctgggattacaggcacaagccaccacaccgggctaatttttatatttttaatagagacagggtttcaacacgttggccaggctggtctcaaactcctgacctcaggtcatccgcccacctcagcctcccaaagtgctgggattacaggtgtgagccacggtgtccggccctcacgtaacttcttaaaaataagtcaaagtgtattttttcttaatttccacaaattcaatcaatggtttggaagctactaggaaaatacctcgtcttcattacgttgctgagtaggaaatcaaatgtcaagtctaaataatgcacgcaagtcacagacactgatatcacactgaggaagataccagaataccagaaagacagcaatgggacacagcccagatggtagtacagacccggtaaatcctccattatccatgatgtccttatttcacactgcatgtctgtatcaaaacatctcatgtaccccataaatacatacacctactacgtagccacaaaaatttaaaacataattttaacagttttttaaaaacataaacagaaaaagaagtcagaagaagctgagcaaaaaataaagctaacaaattctttctaaaagaaggcatgtgtcaagtccaccattcgaactctgcgccttctgttaatccctatgatttgcctttgatgttaaatgtcagcaaatttaacattcttcactattgcagaaccactcacagaaatgctacattgtgcctccgatgctccagttaagaagacaaaaatgggtatcatacgtacacatatggggtattttagtttttaaaaatctcattctatagcctattaaacaaaaggttctagagccaaaaacattaatctttttttttatactttaaatactagggtacatgtgcacaacgttcaggtttgttacatatgtatacatgtgccatgatggtgtgctacacccattaactcgtcatttaacatcaggtatatctcctaatactatccctcccccctccccccaccccactacgggacccagtgtgtgatgttccccttcctgtgtccaagggttctcattgttcaattcccacccatgagtgagaacatgtggtatttggttttttgtccttgcgttagcttgctgagaatgatggtctccagcttcatccatgtccctacaaaggacatgaactcatcctgttttatggctgcatagtatttcatggtgtatatgtgccacattttcttaatccagtctatcatcgatggacatttgggttggttccaagtctttgctattgtgaatagtgccgcaataaacatacgtgtgcatctgtctttatagcagcatgatttttaatcctttgggaatatacccagtaatgggtatattactgtaatgggataaaatgggatggctgggtcaaatggtatttctagttctagatccttgaggaattgcacactctcttccacaatggttgaactagtttacaatcccatcaacagtgtaaaagtgctcttatttctccacatcctctccagcacctgttgtttcctgactttttattgttcaccattctaactatgtgcaatggtatctcattgtggttttgatttgcatttctctgatggccagtgatgatgagcatttttttcatgtgtctgttggctgcatcaatgccttttttgagaagtgtctgttcatatcctttgcccactttttgatagggttgtttttttcttgtaaatttgtttgacttctttgtagattctggatattagccctttgccagatgattagattgtaaaaattttctcccattctgtaggttgcctgttcactatgatggtagtttcttttgctttgcagaagctccttggtttaattagatcccatttgtcaattttgactcttgttgccattgcttttggtgttttggacatgaagtccttacccatgcctatgtcctgaaaggtattgcctaggttttcttctaggtttttatggttttaggtctaacatttaagtctttgatccatcttgaattcatttttgtataatgtgtaaggaagggatccagtttcagctttctacatatggctagccagttttcccagcaccatttattaaatagggaatcctttccccattgcttgtttttctcaggtttgtcaaagatcagatagtagtagatatgtggcattatttctgagggctttgttctgttccattggtctatatctctattctgataccagtaccatgctgttttggttactgtagccttgtagtatagtttaaaatcaggtagtgtgatacctccagctttgttcttttggcttaggattgacctggcaatgtgggctcttttttggttccatatgaactttaaagtagttttttccaattccgtgtagaaagtcattggtagcttgatggggatggcattgaatctataaattaccttgggcagtatggccattttcacaatattgattcttcctatccatgagcatagaatgttcttccatttgtttgtgtcctcttgtattttggtgagcagtggtttgtagttctccttgaagaggtccttcacatcccttgcaagttggattcctaggtattttattctctttgaagcaattgtgaatggagttcactcatgatttgcctctgtctgttattggtgtataagaatgcttgtgatttttgcacattgatttgtatcctgagactttgctgaagttgcttatcagcttaagtagattttgggctgagacaatggggttttctagatatacaatcatgtcatctgcaaacagggacaatttgacttcctcttttcctaattgaataccctttatttccttcttctgcctgattgccctggccggaacttccaacactatgttgaataggagtggtgagagagggcatccctgtcttgtgccagttttcaaagggaatgcttccagtttttgcccattcaatatgatagtggctgtgggtttgtcatacatagctcttattattttaagatacgtcccatcaatacctaatttattgagagtttttagcatgaaggttgttgaattttgtcaaaggccttttctgcatctatggagataatcatgtggtttctatctttggttctgtttatatgctgcattatatttattgatttgtgtgtgttgaaccagccctgcatcccagggatgaagcccacttgataatggtggataagctttttgatgtgctgctggattcggattgccagtattttattgaggatttttgcatcaatgttcatcaaggatattggtctaaaattctcttttttttgttttgtctctgccaggctttggtatcaggatgatgcttgcctcataaaatgagttagggaggattccctctttttctattcattggaatagtttcagaaggaatggtaccagctcttccttgtacctctggtagaattcggctgtgaatccatctggtcctggactttttttggttggtaggctattaattattgcctcaatttcagagcctgttattggtctattcagggattcaacttcctggtttagtcttgggagggtgtatgtgtccacgaatttatccattccttctagattttctagtttatttgcgtagaggtgtttacagttttctctgatggtagtttgaatttctgtgggatcggtggtgatatcccctttattattttttattgcatctatttgattcttctctcttttcttattagtcttgctagcgatctatcaattttgttgatcataaccagctcctagattcattgattttttaaagggctttttgtgtctctatttccttcagttgggctctgatcttagttatttcttgccttctgctagcttttgaatgtgtttgctcttgcttctctagttcttttaattgttatgttagggtgtcaattttagatctttcctgctttctcttgtgggcattcagtgctataaatttccctctacacactgctttaaatgtgtcccacagattctggtatgttgtgtctttgttctcattggtttcaaagaacatctttatttctgccttcatttcgttatgtacccagtagtcattcagcagcaggttgttcagtttccatgtagttgagtggttttgagtgagtttcttaatccagagttctagtttgattgaactgtggtctgagagacactttgttataatttctgttcttttacatttgctgaggggtgctttaacttccaactatgtggtcaattttggaataagtgtgatgtggtgctgagaagaatgtataatctgttgattaggggtggagagttctgtagatgtctatgaggtccgcttgttgcagagctgagttcaattcttggatatccttgttgacattctgtctcactgatctgtctaatgttgtcagtggggtgttaaagtctcccattattaacgtgtgggagtctaagtctctttgtaggtctataaggacttgctttatgaatctgggtgctcctgaattgggtgcatatatatttaggatagttagctcttcttgttgaattgatccctttaccattatgtaatggccttctttgtctcttttgatctttgttggtctaaagtctgttttatcagacactaggattgcaacccctgcctttttttgaaaaacattaatcttaattcctacattaaaaaaatggctctggcaaagattgctcatcctccaatatgtatctttcttcaccctttatgtagtattagaaagtttaggggacaatttggctatctagaaatgtcactacagttcccactttcccttgcagttagatgtggcatgtaaccaagtattggccagttggatataacgcatccaacttcgtcattaagacgtaaatgggcatagatatgctctcttcttcgtcctccctcctgaaggtcgtgatacacacatgaagctggtgagctatcctcaaccgtgactacgaagacagcgtcccaggggatgatcgaaaaactgggcaacaggactatggatccctgaatgagcagagacttcctacaaggcctccatcactcccatctacacaacatttaagagaagtaagtctgaaagagaaacaaactcattttttagttcatccatccttgtgtttttgttagtgccacgaaacctacagcaatctcatatactgatatactctaattttctagcagctgagattttactataaaaatgtatctgtaaaagcttatatgtgagtttaaaataaactttctactataaaatcagatgtctctctaaaactctactctgtctctctaaaacatactctcaatgaaggttccagtcattttgcttcatcgtttttcaagtcacatacctttagatattacactaacccttgcattgtaggaaggcggggacactgaccccgtgcctaacagcacagtacacagataataaatatttactaaattgtttggggtaattttaatttcttatttaaggtcatttgtgcttccaatttcaggttttatataaaatatgttttaaccaatcaataccttgaaaatggagtaatatggcataaaatattcatagtttcaaatatatgtcttcccaatattcctattcatatttcatatgtgtttatacatatatacatattcacatacatatatagtataccaacttatatgtgtgtgtgtgtgtgtgtgtgtgtgtgttttcttcctctaatttctctaattctaccatttatatctttgggtatacatttactttctaacttattttatattttattcctttattttttcctgtacttcacctgagactttctgtcttggctattataatccacacaatagaacctttctcataaaatcaagaaggaagaaaaagaaataagcactgttatggcaaattctcctaaatcaatggaaggtcagagagaaaataatagaagatttagagaaatgtacctagaacaatttaataacccaatataaaagatttctttttaaaagcaagtttataataaaattttcataagcatcaataaaaaaactttctcagaaatttattagatggcacatgaaagacgtctagcctagtgatttctttgttcttactgtttcatataattcttacaaacaccctaaaaggggggacctatttccaagatgaggatgaggaaatccaagtcacacctatgaggtgtgggaggaaaaatgggatacccagtaaacaaaccgacattccttggctgacagagattcatgaagtccagagaagaaggatgaacataataactctgtactgtttggtggatgtttcaataattttaaaagtcagtatttggttggaattcatatgagttggtaattgaaacgagattttgtaaaagtactaaatttaatttaaaataggatagttacaaaatgtctcagaagaccaaataaattcttaatgttattttccttaatcctaagtttaacaattttattaattttcaaatacgtctcatggaaaaacaccaagtcttatttattttaatcagtcatttataaataggaaaaaaatgattcactggatacttttaaaatgcaaaataattcagaagtaaactgctttagacaagtggtttttacataccaaaaaaatcaaaacaaaatacacatatctcgtgaaaacttattatttcaaattgacatatactgcacttaaataatattcctctagaatgaccgtagtccatagagtttgtaattgcatatacaaattaattgtgagctatgaggagaacctaaacataaatattcccatgtagcccgttttggaattttgctttttttctcatcatttataatattcttagctatgtactcatttattccacaagtctatatgtaaagaaattagaagttagcacaagagatgtccccaaaatatagaaacttatctacacttacactaatttcagtgaaaatcttattcttcctgttatttgatccaagactccttaaccttaagcttttttctgtaaagggctagataataggtatcttcaattttgcagaccactaaagaccagatgcccccaactcagctctgtcactgcaaattgtagccccaaagcatctggagacaatacattaagtgaataaacatggatgtgttccaataaaactttatttacaaaaatcaggtagcaagtctattttcaccctcaggccatagattgctatctcctgatgatgaaattgcttcccacatttaaactaatttctctgaacttctcactgttgattatctttcctctctccaatctctccccctccaattgattctcattgggtcactttcccactctattgcatgtccaagctagccatctctgaaatctcactgccctccccctgccctacctccattgctgtatataacaatgtctcaaagaaatcatgctgcataaaaccagtggccgcattcgggaaactttaagtcggcctcactttggagtaaaataaacatgaggtcaaattcaggttctggaatttataggtagtgtgtacttgaacttggcaaagttttttaatttcacactcttggtacacacctgaaaatagatatgatactaatttagagggtaattgtaaggctcacagacaacatacagcgattgtattgacattcagcatcaccctttgccattcaacttttataaaatcactttcactgcctcattgtttttatttagtgcaacccagaatagagaactaacaacaataaagaggagtttggttcaattagattttaggttgtaaaaatattctactaaattgacacatcttttctaactaggtaaattttctccaaggacattagctatattcacctccttaacatacaccagttgcttggtttatcccgttacctttcacatatatcactaaattctgtgtgctttctctttatttatgttacatacctttgtctcttttccttattccttaaacaaagatgtggtatatccttcataagggagagaaatccctatgggggaactaatgggtagcttcctgtctctacttcttgggcatctatagtgcttctgtgggatagtttcattattaaaattagggaaataatataaataactagtgagctaattaggaagacaattataagggtgtgattgtggaaatggggaagttcttttatgagaggtgatgtagcatctcggaagcctcacgacagtagacagtttattttgttcagcacctgacatacagtataacatactatatgtttgttgaatacaataatgtgtctcttagcatatgacatgtaacaatattccattttaccttatactgatatgaggacattttttttcctaagagaattagaccaaggcatctttccatgacagagcagggacaagaaatgacacaaactccacttgtttatttcacttactgccttcttcaatgcagtgttggcttccctattcaaggaaagagattcttggaatctcttcctattcctttcctattcaaggaaaggtcttcagagcctgccatttcaaagaatggtattaattcttgggaagactctggtagatttcattaacacctgcaaattccaccctctgcctcaaggaaagtaataaaagtcctctatcctgttggctgaaagcagtggaaagttcttcaattttatcattggctcctaataggagtaatcatgcttcagggtctgtatctctgtgtcccatagacaactaaagcttttgatcttagggttcatagaactgagaagaacgcagtaagtcttttgcatttcagaaaaataaaagtatgaaaccttttgataagtttccatctcttgttatactaacattacttctcatattttcaagtaaaaaaaaaactcaaaatcagggtgggctaagtgataagagcaatcacttctgatttggtgaagatactagaagaggattaaaggatatgtacagatatgtgtatattaccaactgaggaaatggaagcatgagcagaaaagcgaaacagaaccctaagtgaggtgaacatagaaagtaaacgtcctaaagtcataaacagagacaaaacctcactgaaagttttcacttataatatttttaaacagatttgacatttctttccatttattttctgtaggtatagaatattttataactgacctatttataatgggactaccaccaaatatccatttttaaaatgctctctccatagcatgaatgtcttataaaatctagtctctttcttaatattgttaatacagaagcttctccttcaaagattgaaggtttttttctgcttttggaaataatttgagaaataacatagtactcacagccacttgccaacctgaaaatgttcagcatttatgtaacacttgaccttttcaaaaataaagtacataactcaatcttttcaactactttgccatgagatgtccagaacatttctgtgtagtaaaatagatttcctaggttactctgattttgctgacaaagattttaagtattctactacttaagataacataatctataaacacactttagtgttcatagacatagcagcacatcaagagcaccaaaaacgctaataaataagagagaggcctgacattatgcatcctattaaggatctctgattttccacagaagatatcaagtaccatatattacatcaaattatctgaaaacctgtatattaaaaattggtaaagtttatttctttcttaattcttaaataagcctgtgaagagacattataatatgtccttctagaaccccagttcatcgtgtgtatctcctaagtgggtgctatccactgtgtagactgtgctttaaattataatgctgtcttcatcatctaaattcttttagaatttaccaccagaactgaagtatagtgaattaagtgtttaccatttgtgagggatggtgtaagcactccactaaatcatctaatttaacctcacaacataagggatgattattgtctacattttactatgaggagacctgattcataaaggttagaaacttgcccaaggtcgaagagctaataaaaagcagagatgggaactgaattcagtatctgtctcacgaaatcctgaatattaacttgttgccagacttttttgtaataactcaaggggaagaaacatttcccagagatagctagatttataaaatttaatttaaaaatcaaaatataataatgtgttatattttatgtgaatgtgatcattctaagtctctcatacactcacagaattgtggatagatttctttgattcatccagtctttttcacccttagaaatttctgtgaccaattttatatgtttataatatgattgtatatggcatataatttttgcattctaaacagatagcttgtctatataaaaataaaaaatgaactaccataagtttcattagcacaatgccttaaaatttactcacattttaaattttaaatcagtacataaaatatagatacaatgaaatatgcagcaaatattactgggattttgttggtatataatcatacccgaaacctgtcaaaacttaaaacacacccattggtacatttcaacttatttgttctactttggaaagcagaaatggaaagaaacagaataaacagaaatacctttttgtcacatagtgagataatcaatactatgtttaaaaacaaagtttctttatattttcaaaatagcctctagtggaatcagctaccatattcttgatttgcataatacttataaatttcctacaaactcagtacatattctatttggaagtttttatatataggctttatattacactaaaaaggtcatcaaattattgccacgtccataaattaaaatatgttaaactccaaatatgaaagtacggcagctcttcaaaaaccttaacataaaggtaaattaaaattatgcaaattgagtagaaaactcatgcagaaactgtaaatctggaatagggaagccatttaaggtaaaagagaaatcgtcacaagtatgcttagaatttcctgatttagaaatagtgggacaaaatacaatcctacctatcaagcttttcagataataacattgtgcctaggcctgaaagtacatgcatgacatttgtttgaaaggattgtgattgccttgtaaacttcttttacaaatttattaacacgggttgttccgtatagttggccaacattgcttatttcttccactgccctacaacaaccataaactcccaattattctgggagtagtttatcagagtacagattatctggaggtgttatttctctttcatttggcctttcacagctcattagtacctcaacaagaaagttaaggcaaaggatggaaaggctgcagaatttctaaacaaataaatttgctccttgtcagcagcatatacagaacagcatttagagatatcacacaaaataactaaaatgggataaacaaagatatttaatgtatactgtggcaattttccttgagtgatttttccctctgtactgtcaaaaatattgactgaattgactgtaggttttggcatccaacagacctcaaagtcctttgtttttagcatgtaattgaccatctttagcgatatcacctgccattgagtaatgcattacatttgttgccaatatattgactatttttcaatgtgaagacaaaaactgaaaaccaaatttgcaaaggaagattgatgataatcttgagtggagtctactagaaagcttgtttgattttaggcttgccaatgcattcgatgccatcagcacagggatatctatccttgccttgaggagaaataagggaatcagaaaattaaggctcttttagtatctactcattagaggtgatatatccttaatcatgaaaataataatgtgttatatccattattattttgctttttaataagaatgtaagatatccataatcaattggtaaacttatctttgtctagcctatctactggcaattgaacaaataataaaaaaacttcaaatagataattttttacaaaattattttaattacagacttgccaggtagaagagcaactaacaaaagagcctttatacattcaatacatcataacttcatttattttatagagaagagcttgaaaatcatatggaattctggctctgtcacttagtacaaatagtgttgctttaacaaatatttattaagcaactacaaaggaccaggcactattttaggcaatgatgatatagccatatacaaaacagacagaaatctaagttctcattcagtgaatcatgtcactgaaggcatgctaatcaagagaaataagtaaaatagaaggatgtaagtgttatggagaaaaggaagcaaggaaggggaattgaaagtactagggaaaatatcattgagaaaaagatttaaagatatgagagagtaagtcatgtgagtatgtggaggaaatgtgttccaggtagaggcatctatgactgcggtggaatgagagacggtaacaacggtggaaaaggaagccagagaagaaacatagagaaaggaggaggtgattgtgcatgggcttataaaacagcaggactgcattttactgaatgtctggcaaggcatgggaaggttttcagcagaagagtgatgtgatttgccttacgttttaacaagaccatctggcagacaaaatggattacaggtaaggcaaggccaaagcaggcaggcttgtttaaaaggctatttcactaatttagaccagaggtgatggtggtggccatgtaagtagtcagaagtgatcagattctggatatatacctggttaaggtggacctggcataggtttttttttttttttttttttgagatggagtctcgctctgtcacccaggctggagtgcagtagcgcgatatccgctcactacaagctccgcctcccgggttcacgccattctcctgcctcagcctcccgagtagctgggactacaggcacctgccaccacggccggcaaattttttgtatttttagtagagacggggtttcaccgtgttagccaggatggtctcgatctcctgacctcgtgatccgcccgcctcggcctctcaaagtgctgggattacaggcgtgagccaccgcatccggccaaacctggcatagttttctaatcaacaacatcaggtgtgagaaagaacaagactaagtttgactcaaagatgttcatttggggcaactggaaggctatagtgaaaccttactgacacaggaaaaactattgacgaagcagatgtgggtgttagtaaatttagttttacatagggtaaatttgaattgactaggaatgtataaaaagttgtgtatctaagtttggagtttggcagaaagctctgagctgggggtaaacattgggaggcatcaacttacagacagtatttgatgccaggaggctagataagatcatcgagaaaatgaatgtggtctaagaaccaacccctggttactgtcatatcaggaatttgtgttgatggggaagaaccagcaaattaaaatcaaagcagatgctagaaaaacaggaagaaaacctggaatgtgtggtgccttagaaatcaaagaggggaaagtaaatgcatgtctcaaatcctcctacatttacttaagttacttaatttaggtagtacatataaggaatctcacattgtggctagcatactgtaaaaacttaataaatgtttgttgaacaaattatgtgtcatttcataacccaaccaacatatatcaggatactggttgtgatatatgcagaatacatttggcaattgagtgttaccaatatattatcaaacatgctagagaagtgtagtgtaccgagaattaagaatatgggctgtggaatcaaaatatctagactcaaattcttttctgtaccactgaaccttagtgttctcgtctgaaaatgggaataacaagaatataaactcctaatgttggtaagctaagttaaacatgttaataatatacatacagcatggaagaacctggtcttcagtaaatcctcaacaaattttgttattgtgccaattaaggcacacttaagaagcaatgtcttatgtattcaattaatactaaaatgagcacatattgtggattcatgtatcaactatgtattaatcactcacttagatcacaatggatataaagaataaaagagctgccctcaaggaaatcatagtccagtggaggaaacctacaagtaagcaaaaaatatatgtgctctcataagaacacgtccaagaagaaatggaagcattgaaaagggaagcgaaatatgaactgagaagtaggaatttttacacactactaagaccttgtcaagttagtgtcttcccttatggcgccatgtctaatacactcagcgttgtttcatcaacgtgttttcccggtaatcttttgggggaattgacagtcaaaccatgaacattggtactacatttatatttatgaaagatcattctggatgcagtgtggagaatgatctatggaagatgagggcagcaagaccagttagatatccagtgaatgacagtatgtaatagtcagaacctgactgctgccataagaactcaagaactgttgaaaaaatgaattgatgagatatatactgaggacttcaacaaaacagaagtagggaaagagggggagatgacagacttctgacatatatgatcttagagtgtattggacgtgggcactataaatatgacaaggacagtacagttgttgagaatgattcctaggtgtctttttttattattatacttcaagttctgggatacatgtgcagaacgtgcaggtttgttacataaatatacatgtgctatagtggtttgctgcacccatcaacccgtcatccaggttttaagccctgcatgcattaggtatttatcctaatgctctccctacccttgccctccactcccagacaggcgatggtgtgtgatgttcccctccctgtgtccatgtgttctcattgttcaactcccacttatgagtgagaacatgcggtatttggttttctgttcctgggttagtttgcttagaatgatggtttccagctccatccatgtccctgcaaaggacaagaactcattctattttatggtcgcatagtattccatgtatatgtgccacattttctttatccagtctatcattgatgggaatggtcaggagttcgagaccagcatggccaacatggtgaaaccctgtctctactaaaataacaaaaattagccaggcgtggtggtgggtgcctgtagtcccatctacttgggaggctgaggaagtagaatcgttgaacctgggaggcaggggtgcagtgagctgaaattgggtcaatgaactctaacctgggcaacagagcaataatctgtctccaaaaaaaaaaaaacagcaagcaaagacaaagcaaggttttgtgaggcaaggaattcaaaaccaccatatgacccaagaatccctccttctgggcatatacacaaaggaaaaaataacacaaccttgtaaagatatccgggcttctatgctcattgaagcattgttcacagtagccaagatatggaaacaacgtttaagtatccatggataaatgattaaagacattatggcatatatgcaattgaatattattcagtccttaaaaaaagaatgaaatcttgccatttgctacaacatggatgagcctagaatacattacactaagaatttaaaccttggatgacatcaatgagctctagaactcctcatgcgtagaaatcaccctacatttgactttcagtttatttaacaggtaacaacttctggttattactggcccggaagacgtttgtagtaaacagaagagacaactgtctctgtcctcatggaactcacacttttgtgtgattatacaagcaataaataaataaattatattgaacaaaaaaaagtttgttccaaattatatttgcagccactttatgaataaattgttgagcttagtgctgtgtgacacgataaattggaggattaagaaatgcattaagcaacaccaacaagggagtacaaatattatatttaaccatcatatttcattggaccttaagtgccattcttctagttttatggaggaaatgtattaggacatgataatcatctaatactgcactaaatattgtagtttactgttactgaaagcataagatggaaatcctaggggtcaacattatgtgacagaaaagatcacatgtataatatttgtcttttctacattttgtctatttgacactgggtcggctacaccttcgcttaaaagttctcaccattctctgcttttgtgttttttttttttttttttccagttttctactcaagtcagataatggtaaatctaattgcatcttgatgagctacttaaaaatacccttaaggctgggcactgtggctcatgcctgtaatcccagcactttgggaggccgaggcgggcggatcacctaaggtcaggagttcaagaccagcctggccaacatagcaaaaccttgtcactatttaaaaaaaaaaaaatacaaaaattagtcgggcatggtggcaggtgcctgtaatcccagctactagtgaggctaaggcagaagaatcgcttgagcccaggaggcggaggttgcagtgagccgagattgtgccactgcatgccagcctggcgacagagggagactccatctcgggaaaaaaaaaaaagtacacttaaatgacatacatttcatctcagagcctaagtataatttgaagcatttcaaattgctggcccatttgcttatcaaatcttgttatatttttgaatcacatttcattgttaaacaccctcagtgtatacactcatatgtccctatgcctatcaactttgtggactgagacaagaatattttttttacctcaagtgtaagaatgtaatcactatcaaaactcagactatttactgatgtttttctaaatggaatagtctgttgcattattcagtcatgagaaatcatgtttttgacagggcttgtttctcaagttggcttaaaaggttccttcgcatctctgcattattcacacattgctgtagaaggtgctaaaaacttggcatcaggagacagagtcctactgatcagcaggttatcatatgaatagtggaattccagcagcaagtgttttaaaacaaaatgccgcctgatacttattttatcatgttttataaaatcaaatcatgttaaactgttccagtgatgtcatggtctctgctctcttccctatgccatcttgctctctgataaaacttgaacttgaaagattttttttttttaatgaagggaggaaaatacagagactacggcattgaagagaattaagtaggaatcaatactaataataatcacttactaaaaatgggagtatgttagttaaatactaatgggattaaaacttcttatcgaagctgtatgctgaatgttcattacatttttctggacatttttgtcctgaaaaatcaacatttataggttgataccacatattttatatagcacattgtatgttatacacaggaatttacggtgtactgtagattcctaccacagagtgtatcatcaaaattaggagtttatcagaactcttaattctctcccaatctgaaatattaacatcattcttctatgaactatcccatctcctccttactttcatcactgaacctcagaattgattaaactttcctccttccagtttcccataatcagccgtaattctatgtattatttcttgttttccacacttatacttaaaaatccctctcacagcacacaagtatacttctaaaacagtagatccagttgcccttcccctacctgcatcctcctcaattcatttgcagcactgtttaacataactaccttctttaaagtctttttaaatatctgttatgtgatggtactttcctaaggaaactcttaaatcgtacctaactatgtctcccacctctagttccctacagatagatagatcgatcaacaaaacaatcaatcaaatattctgtccttgaacctcttcaaatttgattgtactttttttctctgtgaaatttcatgtactttttgggattactctgttatctctctccaccctagcccctgcaatgcgattctatcactggtcttaactgatctgttgataataaaccctgatttccaaatacagttagcttattctggaggcaaccttgacactttcaactcagcatggccctttttggttttttttggcaatccttcctaaaggcaaagtgcctctccattcagcttcataagtcccagggttgaaacacatgacttgttattcaaaacctgccaatgcccttctcttgcctactgaataaaatgtatctccttgagcatgatatgcaaaatcctccacaatgtgtccttcaacctcattttccagccgcctctcctactcctcctcccctaaccatatgccctacacacgaaacgaacagtcacaaaatgaactgacgattcgtgcttctttctcatttagctccacaaagtgaagtaatatttctatgggatgatctccttataaaaatcatacttgactatcaaggctcatcattcagttataccttctgctacctgctaagccaagatttatgaagctataatttatggtcccagaggatttatatgaaaagttattatacttcctatctctactgtgtcttaaagcagctgtaagagtgtctgtctcctctctagtgcataaagaacctgaggacaagtcaagtaacacccagtaattaacacaaattagatgatcagtaagtacttgacagattaaattactagtgtttgaccttcacatatgacactattatgtatattttaaaagtatcactgttgattagaaataaattttaacacaaaggccagaagacataacttagaaatcataggtttaggaattcaagatgcctaggtctattttactctgcctcttactagcacaaggacccttcagtaagtcttaatcttaatctgtatagtgggaagcttgattggtggtaaacctcataaatattgccattcaagtaactgccacatgctcctgccatattgtaagtgtacaatgaatgctacctaaattatcataaaacagtcaacagtgataacatgtatatgtgacgatttttgcaaaccttgttctatttggaattttaagaaagtaagcaacatgaaaccactggttgagaagatgtaattatttgtaaacaaagacctttatttttagtaaagattcatcagtgcaacctgtcagaattttctacttcaaatgatttaaaaataaatgattcaaaagtacagtttttttcctgctatggcagtagtgaacactgtactaatttgaacagattctgtgaatgccaaaagcattgtaatgttgacaaatgtgtacttctaaacagtgaggatgtgtgtgtgtgtgtgagtgggagaataatatacatataaagtacattccccagggtttgcttaggttttgatgacctaacccaaagcatcgcaaagatccaccaatatagatgacagtttatgttggaacacaatttaagaatatatactcagctacaagtgggtcggtacaaattgttaatatctcaatgtcaatactactcatgagtaaattaccaccaagataattatacatatatctctcaccttggatctttcagaaatttggcctaggtacttatataatgttctgaataatgtatctctctccattatttagtaaattatgtcagattcataaacatttctcaattaccagacatcaaactgttttcaacaaacttcttattccaattaactataacttcgatttttaaatttatgtacatacacacacacactctgagaaaaagagacagagttcaccaggttcccatttatcttcaaaattgaccctatataaatgttattttaaaacaaaagataaaaccataatcaggatactattattattaacaaatcagattacttggctatttctgcatatattttactctctgataaaaatattataatcattttctgccaaatataatctgcacctctgctaattactcattttccattaaaatgtaaaagtcaataaaacttatttagaaaaatggaaaatcatacatcaggttgacctgggaggctcccctattcttgtcctttacaaagtaatctaaccagataaagagcttcattttattcagcttattaaaccctatggtttgtttctgtaaattctatagtacacatttaagaccagtcatctgtgagaagaaaatgtaataccaccaaatttaaataacaatccaaactatgaaagtagatgcatatactttttatatgcttatgctttatataagctgtatagtatgtaactaactcaagtgggctcatccatcattggtttattgtttctctgaaaaaacacccctcaaggtctttatatgataaaatgaaaaatgacagaaaagaaaaatatgatgatattggaaataagcacattctgaaagccaatttgtcattgttttatgacatatatttatcttcatgtatatgagaacacctagcatagtcctttgcttctaacaggtactcaataaacttttgctaaattttgaatatattagttgtgggacaggtcctaaagtattgctctagaaatatttgattcatcagtaatagcctaacctatgctaaagatgactttgattgatagagggcagtccctttgaaagaaatccaactgaaatgtacagaacataaaaaaaatgcagtggatataaaacacagcattttccaagaaaaaatagagcatattttctggatccaataaaattagacacacacacactttcaaatacacttgcaattcatgatatattttattctattaaggatttatattattaaatcatgggaaaacactgaactctttcaaatactaccataaaataatttccaaactatattccatccttatgaaggaatcttgtggcttgggagcaattaatcacctccccaatcccatgcataagtcctgattgctttaaataaatcctttttgccagggacatagaacaaaaatccaactacaacattttatgctttaacacagtatattaactgtggaaacatgacttaacatgttccaaccagaaggtgtccagagttctgcttgactgagaaaaaaagtacttatttttcctttgacataagcaaagaaaaaaatgttacagttctggcagccatctatcataacaaaactgtatagggaaagaaataactacctggcatagataacggaagagtgaagagccaaaagagccactgagatacggagctgcagtgtgatgacaatgtgaatatttggattaaaggcttaccagaatcctgccattcctttggaattttctgttacataagccaataattcccaaggtttaattacaagaaatctttaatggaagaaaagatgtcacatgttactgctccaatgtggatgttttctgtatgtgtgtgtatgtgtatgtgtgtgcatgtgcgtgtgtgtgtctgcatatttcaagttttcttgagaagagttttccattattgtaccaaacatcattctagtttatatggactttggtatcaggaagtgggttgttgaaagttaatagatcctataatgtggaacaggctgaattatgagaagacaaggatgataaacctcccccaccccaactcaaaatgatacttggtacatgattaaaaaacagttgattaaacaatggtctattttatcctaagtcatgtgccttacgagtaccaacactattaggagatttgatagaaacaaaaatgttgccacctactggcctctttaaaccaagaaagaaaaaacctcatgctaatggttacttgtttttgaagtacagaaaaaaaagaaaatatagctttgtctgaagaagccctctctgcctgtggcttataacgtgaacgccttgagaggctgataatttggagcctgatatgagtggaaaagccaatttgtatttttactccaaatcgaatgtttgtatgaacagagacaggagaggcagaatgtaagacttaagtactaaaaaaaatcaactatagtgcttccctaaagcacttttgtgacaaagtagacgatccctcctatcatgaagaagcagcttctatgtaatctatacttcaaagatatactcaaagattggctatgccctctaccccaaccctgtgctgcaaattttctcagtcaggggattgtgcaaagcacagaggcctcttaaagatgtcaaaagaggttaacatttgaagcctaaaaccaaatcatagaatttgggttactgggtcatggaattgataagaacaaatactgaaagcctataaatagtaaacaaatctgattgccaaagaaaccccaggtctaactaaaaacaccttgttatcactcaaacctagggcaagcaccaggacttttaaacaacacaataagtagaataataaagtaacacaaaaccccaaaatatgtcaacttcagatatcatgatgaagacaagtatttagcaaaatttataatgaacagaaggaaaaatcaccaggaaggctctgaaagtgcaggatataatatctgtttcaatttggtttcttttataaatttagtttagttttaatcaggatgtgcccttctaactttttacttagcagtactggacatcaaattttttcacttagtcatagtccactggatggatcataaagactaattgaaagggactgctaatcacccagatatcccaaccttggagctgaatgcaatcactggataatgttttatacttgctctttttgaggagtctgagcatctttgaaagtgaatatatgctatgaagggtgtatagcaatgttggatattcaaagaggaggactgtagtaagcactgcaattatacagtcaatatcctttcttctactctctgatggcacagtagcctggtgatttggaaagcattgttattactctcagttctagatatgcgctcggtttttgtgcaagccaagtgggatactgctatgtactttgcttcagggaggtgttcaggccaggcatatgatctaagagtttccaagcagagagaaactcagaccttttgtttcctatttgggtaaagatatattctttacatttagctgtaaacaagggaaaagagtttccaagatctgctgagggaagccggtctgtatgagttcgaaaagttatggagggtaggcttagattaacagagaagcaaagacttctccttaaatccataataaaactctgtattaaacccttgagcaaaccttgaactctttacttagccaacaaattctctttgtatcttgagtacatttgaaaccaagcatcctaaataatacaggatataatagactttaatgttcttcatcaacttaataaatccttaaataatcaacaatcattctaatatgtacttatatcatcttcagtgccgaatgttctgatttcaaattcaatgttcaattgctcagttcaccaaatctagttaattgctgttagtcaaaaagcattctcattaatgacactgatgctattatcaataaaatggagtcattttgaattggtttgcttattcatcaaatggaatttttagaaaggatgtattatcttactacaactaggatgccaaatgggaatttaatgcaccattttttcacaggcttgctataaatcagaatctttaaaacatttctctccaattctctctcttccactcctgaaagagatggtaatatcatctgaatctctttcaaggaaaaaagattaatgaagtcatctgttgatagatttcacagcaattattcttcctcattaccagttcccaaacttcacctttcattttataaagtaacctttattttaaacctgcctgtattttaccttcttattttctggttgcctgatttataatttgtcattatattgcttatatattcatccacttttagtaaatcatgaagtgtgtgcataagtgtgtttatgaaaacccaacctttcctctaatgatagcttcataaagctctatgttgtgtcattttagcatacaggttaatagaatcaattctggaatgagattgtgtgtgtgttcaaatcctggcacagctgcttttcatgtgcataactgtgcacagatttcttaaccagcttatcaattttctcaagtgtaaaatggatatattaacagaatcttctcaatagggttgttataaacattgaattaatgtatgaaaagtgtttacagcaatgtttgttatataatgattgtccaatatcagttagtaatttttgtgacattattcatcatcacagacattatctaagagtaactggttcattatctaagatcaacactcaggaaggagcttaggctaataaaatgattcagagcccagaaattggaaaacttgggttgagtgacatacctatcagtttctaaccatactactttggtcaactcattcaagatatataaggttgtttttagttgacagagttaaaaatttcatcttttatctcacaagtaagctcactggggcataaataatacaaagcacgtaaaagggatatgaacattttataaggtgtgaagaatccctcttatacataagagcataacacattcttcagttgaagcaatagagccctttcactacctgttctgggaatggctcaacttatgtagcacttgctcttgtctttccacgaacacaaagtttgcagctgaaacatgaaacctctttcctgcttcccaatctaccagattttcaacatggataatataacataaaggacttatctgtctgtaccatagaaataagtagtattttgcctggctttccaagtcctcagagtctcaccataccctatttttctcagaatttcattgccattttggggcaatgaattcttttgagaatatgattgaaattctggatcctttacactatgtgtacacaaaaatgtttggagattgtgttagcgggattgtggacgctattatgcacatttaacaaactcttagggttttataaactgtgatgattgttataccattttatttatctgcaccggcttatcattacaagctcagttaacattctccatccttcagtaattagtaatgttagcccgtgtctttaaaaaacaaaacaaacacatatgtattgaggtatgatgtcctctgattatatatcttaatgtagtattttattttatagtgtactatttaccagttctgccagtgttaatcattgtccgtaattagaatattatttcctatcttcagttttctctattaaattgtgatttttgaagaccatgtcactattttcctgattttcatttattgaaattgaaaaatatatgtaagagtttttcatttattgacatttaaaaatatatgtaaaagagttttacatttttaaattacatgttttatttatttttgcatgttttaaaatatgtaatttcactgacaaatgaaaattcagagaaatgaaactcctataaaattaattgaaaagagtctagtgtaaaatattctgaatataacctttgttctaagtacatatatagatgtataaccacacaaataatttattttttcaaaaccagtcacaatgttgtcttagctacattttcagttatttaatgtattgtaaaaatatgccatgcaattaaactcttttatatcttaactttgtagtggcttcatggtattatatcatttggagatataatttatttaaagaaactaacagtatattcacatgtgcatatttccactgaacacacattaatttcattaacaaaaagaaatacaagaccaaagaagttgacctctaaactatcttcctatacttctaatgtgaacactattcaatcatctcataatttaaattaaaatgaaataaactacataggcactggaattttgtttctttctacctcttaaaatttggaatgctcccttaaaattaatagattccaataacttacaagaaaatacccacctttacacaaagttactataaaaatccttcatgtgtgattaaaaaataatatttacatgtttactttgtgatcagatttatacttagcagctcaatttttagaataatgatatgaggaaataactattatgaagccattttatcaaaaaaagagcaaaatatcaggatctcaaagagctattagcactccagtgctcattatagcacgattaaaaatagtcacgatgtgggaacaacgtaaatgcccgatagctgaatggataaagaagatgtggtaaatacatacaatggaattttattcagtctttaaaaagaaggaaaacttgcaatatgtgacaagttggatgaaccttgaaggtatattgtaaatgaaaaaagctagacacagaaatacaaatacttcatgattctactcacaccaggtatctaaaattgccaaactcagagaatcagagattagagtggtggcttttagaggctgaaaggaggagaaaatggggaaatgctaattaatgggcataaaattttcatcatgcaagatgaataaattctaaagatctgctacacaacgttgtctctaataatactgtattgtacacttaaaatggttatttgataaatctgttgagtgtccttacagaagaaaagaacagttttaacaaatgttttatgtatcacaaagcagatgatgatgccctatggtgtttcttgctaacaattttcaacacattttttatgtaaggtgaaatgtcaactaaaatatccaaatagacaaaagtgagcacaatgtgcagtaatataccttaagtcacacatttagtaagtagcagaaccagaattacagataaaagtcagactgattagcaactgtgtttgcgtgtccgtgtgtgtgtgtgtgtgtgtgttgtgttgtgtatgtgtgtatgggtgggtgcctacatgcttagtatattttaatctcctaaaatcaaagggcaactgtccaggccaatatgagtacattctacgaaacaagaataaacactaacatgtgatcccttctctactcctccctcattctctcacagtcagagttatattatctttccctgccccatgaccaaaaaagaatctgtgcttttcacattctgtcctttgtgaagagaaaatttgactggtcaacataaacttacgcacgttgtcactcctgtgaataattctaataaataaatgactaggaactttgactccctccttacaactttggcaataaaacagatttttaaacatataatttgcataagttaatcatgtaaatataaaaatttaaacataaaacaaatgtactgaaagaaaaaacaactattatgaggtcatgtataacaataaaatcaccactgataaacctaacacactaaaaagtaagataagtctcaaagtcactggaaaaaaatatgtaatgaaaaatttaaagttataaatcttacaaaaatataggacagtgcctaattatctgagtgattaatattgctaggtatgctaggggagatcagccaatgcttagtccagtgttatagttgagccttttgtatttctacagttatatgttttgcttcatgatatggtataattggagttattccacaggggaagttaatagaaggaaagaataaagatcagaacaaaagtaaataaaatagaaactagaaaaacaatagaaaatagtaacaacgaggttttggtttttttttttgtgaaaagatagactggcttgttcttgacatttactgattccacaatatgcaattcagatttagtaaagaacatttactgaatggaaattgtcacccaactctttctggttttttgtccttgttaagtgaatgaacaaaattggcgaaaaattttatgtccgaaagttcttaaagtctaggggaaacatttcttatgaactaaatgtaattcaaaaacatttaacagaaggaatcttaatgtcaggcagtgagaaaaaatagaaagtcaaagatctctaaagatgggggtgatgaaaaagaaaaggaactgccttttatgaaaatggaaatactattttgtttactggggggtagatttaggtaaataataaaatagaagttttaattggcaaagcgaaaaacacttaaaacatgctgaaaaagaccacgtcaatcaattttactcactttaaacatgtttttttcattcccttttcacagtatactgagactgaaactgacacaagaaacgttcactaaattgttgatgttcgtttcgctctaatatttgtacttttttttttttttttttttttttttttttgagacggagtcttactctgtcacccaggctggagtgcagtggcgcgatctcggctcactgcaacctccgcctctggggttcaagcgattctcctgcctcagcctctgagtagctgggaatacaggcatgtgccaccacacctggctgatttttgtatttttacttgagacggggcttcaccatgttggtcaggctggtctcgaactcctgaactcatgatccgcctgcttcggcctcccagagtgctgggattacaggcatgagccaccgtgcctggcctaaatttttgtactcttaaaaaactaagctatcatattgattatgaccatgacacatatgaccatgaaaatatttttctaatatttaacgtaacgtttagaaacatcactaagaacttcaaatacaatcaaaatactgactttgaatattgtttttttcaaaggcctgacgtttttgtccaacacaaataagactgtcttcacaactggtcctcaggcactgagtagagtaagtttctccaagccaaaggctgtctataaatcttaatctacttttgtacactactaaaatttcctctcatggaatggtgaaaaatctccaataattcttatgctttaatttattgagaaaaacaattatttcattcaaaattaggtattacatctcaaattatgaatgcccaatatttgttaaaagactcatatatttaatattacttcaaaaattagtgaaaactttatataagccaatattttcaaaatgtacttaaaaatagaaatttcattttgagcctcaacattgtttgctgtctctctccccccatcaactctccttccacccaccccaacctttctccccagcacacacacacagaaacacatacacacacacacacagtcaaagttgttttgaacagaaaaccctcaggctacgccccttatatttgagacgggagtgggggtaacagtccacagctgctcatctacttctggtaccttctctagccttatttatttcctagttacatattttacatcacttttcactgatttcttctccatacattttctacctttgaccagtaagtgatagttttcctctttatctaatctttttgctattaggcgataaagaatcttagagcagcaaagattccaaaatatctgtttcgtccatctcttaagcatagggttatttccatggctttagtaataccatttattgaaatcatgtcccacctaaagtattttcattcttttcttatctaagcctcgtaaaaagctctgttcaagatgaacttactctatggaaatcttcctgagtacgagtcgatggaccattgtaggatgcataaactgccgattcttggatcccattcatcacgctagtaataagccttatatatccatatttgtacgatctctccaatcactgaaattagtttggaaaaatcaaacatgtgtttgaaatacaaggtagcatatcccaccttgtattactcattcttttatacgtaactcttctattacgatgaggttgatgggattaataattcatagtaagagaaggaagatgacgtaaaactgtgctgcagcagggtttatattgcaggacctgcttcaaaaccctgaacaatatattagattcacgggcagctgctcccttaagtattgctgttcactcaactcttagaatatacaatacaatcgcaaactggggcatataaaagaaacgtgatgctttcattcatttgatcaatatgctttatgtacctagtatatattctagtccttttcctcttggagtttttactcattagggaaaaacgacctgcaaatatcgtaatgtcagtagtgataactacaatgaggaaaaaaattaaagctttgaaagaagacagaacaatggtagtggcatatcaaatagggtagtcagaaaagatctctttgcagtctaaggtaaaggaagtgcgccatatgaataactgggggaaaaacccttccaggaagagggagatacatgtgtaaagtcactgaactcaaagtatgcttggcgtatttgatgccaagctagtaggccagtgtatctggagctgagaaatggggttaagggtaggaaagaaggtaggatacctatagggaacaaatcacgatggtgttttggattttcttccgagtgtaaagtgaaattatttcaggatttagaactactctcaacatcttctctacttactcagtttgtaaattccttaagggcaataatatggccatatatgttccccatgcttggttcactgtctctcattccataatagttaccactattccacaagacccatcgattagaattatggatttaaggcttgcaaaggagaagaaagctcatcttagacagctatatggttccagtacatagtaagtgaacatattaataagccatgtgtcccgtgaccgactgccttttacaaccagtctcattaggtagtctatacttaaacactactctgacagagggctcactatcccccaaagccttttattgcattttgagacatttctattagcgagtattcaaatatcacatatttgaccccatgaattttagcaagttaacttagtttatgatttcaattttggaatttaattttttatgcttgaagagttcatatcaaaaaaaacaaattttgagagcatggccatgtttttatttcatagttcattttgtccttagatgtttctgacaacataaatttagcagtgtagcagttattaacaccattcatatttatttccagctttctacctttgagacatgtaatacgaatatatttcttagttctaagttgggtgagaccatgtaactagttgtgctcgtgagttgtgaactgaagcagatatgtcacttccagttcaagcaattaattgccagcacaagacctttcagaattttctttccctttgcggagtgactgggagtatcctagatagtagctgtttcatcaggctgggtttccaaatgaccacaatgaatagcgttcccttgctgattcacagtgcacattggaatgaaaaagttattataacatagtgaaatttaataaccagatctagaatgactggtttagatggcacttaataaacattaagtgactagtaacacattctaacagcagtctttaacctgcatattgtgatacattagtaaatctccaaaccacaattgggttatcatggtaaagagctttatggtagtttctaggacatactaattactcaataattttctattgaaagaaggagtggcgattcctcagggatctagaactagaaataccacttgacccagccatcacattactgggtatatacccaaaggattataaatcatgctgctataaagatacatgtacacgtatgcttattgtggcactactcacaatagcaaagacttggaatcaacccaaatgtccaacaatgatagactggattaagaaaatgtgccacatatacaccatggaatactatgcagccataaaaaaggatgagttcatgtcctttgtagggacatggatgaagctggaaaccatcattctcagcaaactatcgcaaggacaaaaaaccaaacaccgcatgttctcactcataggtgggaatcgaacaatgagaacacatggacacaggaaggggaacatcacacactgggtcccgtagtggggtggggggagggggaagggatagcattaggagatatacctaatgttaaatgatgagttaatgggtgcagcacaccaacatggcacatgtatacatatgtaactaacctgcacattgtgcacatgtaccctaaaagtataataaaaaaaaaaagaaagaaagaaggagtgaatgtaaccattcacctaacaagaagtttttgagacatattgcctcaatatttcaagggccactgagtaataatgacttatttgtttaaaaattaagacggtaaaaatagtaagttgttaaatttccaatgaaaaaaattgcaccatagaagcaaaagtgaaatgttatagcacatacaaaacacacacacacacacatacatacacacacacacacacacacacacacacacacacacagtgtgtatacataatggatttagagttctagttatgaggatgagactagggaaataggcacagagataaagtgctgttagagacaacccatatgtataacttcgaatagaacatactccctatgtaagtgtttagtattattggtagatatgtgtattgctgtatgtatatacccacacacacacatatatatgcacacgtaacacacagatatatactctatttgaaaactttgcttataatctaaccatgtatcagtgctatctttacagcatggtattaagtatataactatagcatgaattttaaagatttcatgatattgcattaaaaatatttaccctaagttttattaatcctatggtgatcactattcaagtgtttattaaactttccctctttgaaaacctgttttaactatgtcttacatcatttcatttaccagattattactcctaaatttaaattttgtgattaaaaaattatgcaccagaaggacagcatcaatttattctgtcataagccctcttacaacttttgatgtttcctgtttctttatgttctgcaaaattatcagtattatcactgtttcaatctgcctatctggtagttaaaaataatttgattgtttatattatatttttttattaagtagatggtatgtctttttacatacttaatgatatatgggctttttcgcttttgtcattttctggctcatgttctttatgaattttcctattggggcattctagttttacttattgatttatcagcattatttatatatgagggctatcaatccttcgtatgttataaatgttactaataattttcccaactttatatttgacttctaactttccttagagtctttcttaaaagcatcataaccaatacatgatgcaagaattgccatactaaattcctttattgactccataaataattaactataatcatgctctatgaagcaatagaaatgttaagatttttaagagcttataaaaactttatttcacatttattcctggcttctaggatcaagtggccaataagcaattattaaattaatggtaatactacagtgcttccggcatacttgttcctgaactatttgaggtaccaaatagttaaaatgactttaatcacctagctcacctgaaatttaaattataaagtagaagtagaagaatccacgggctaatcttatttctcattccattaatgatctaaatttcttcttgaaatgactttttcaggtattataaagtaaatttgaatgtttcagaaagaggactacatatcttaggaagcagataattgccactggatttagcaatctgacacacaatatagaaatttctaattaaagttctatttttataatgctaatctttcagccaaaaatttccttgggacatgttataatgaagataaaatgtactaagattttaaattgaccagagttcccagagacacctaataaacattttcataaatattcactataagtaagttttattgtgaagtaatcccattgttatacatacctctcatcattggcatcattacactttaaataagttacctaatagaagtaagtatttaaaatgctaagcttgaaaatctggatttgctacacataaaagaggaacatgactttatgtagctgaattggtatgcagatgatctagaaatgaggagtttcataacgataccatcaactcatcattaatccttccaaagatagtttatttccccaaagatttaattgatagcattctcataatttaaaaaatgactgtatttctattaaactttataatgaacaaaatatgtgaccgttaattatgtgttgattttaaagtcactctaattattactaaataaggtatctcttcaaaagaattaatatttttctttacattgacatgcttaagggggtaaactcttagtgaaaacaaaaaagtttgctagtagatttgagacccacatggatttaacacatgtatgacataataggaggctctgtgttaatctacaagtttggtaacaagtttatgttgattaaccaagcattattacattttttcactgatattatttgtagataaagaccacaatatgcaaggatatgtgctgccagaattctatagcagggattaaaattaggcatgggtatccactaattatacattttaaggaatatatctgtatggccgggcacaatggctcacatctgtaatcacagaactttggatggccaaggcggctggatcacctgaggtcaagagttcgagaccagcctggccaaaatggggaaacctcgtctctactgaaaaatacaaaaattagctgggtgtggtggcaggcacctgtaataccagctactcaggaggctgaggcaggagagttgcttgaacccaggaggcagaggttgcattgagccaagatcgtgccagtgcacttcagccggggcaacagagcaaaaactccatctcaaaaaaaaaaaaaaaaaaaaaaagaaaagaaaagaaaagaaagaaatgtatctaagttttcattttcaatcatggttgtcatgtatcttaattatgatgttacaacactttgaatatagtttcattaaaatataaggttaataatttaaagagaaaagattaaaaatattaaaatattttctgaaaacaaaatagattgtaataaaattaatgcaaaaaagaaaatcaaattacttaatgaatgtagaaactagagatcgccctacagaaaatgtgacagtgtgatgaattagcttaaaataattataatccttaagaagacatcatgtttaacaaaattcaggatatcaggatcctagaccaaatatttctgctctgtaatcttaggtacatgacttagcatatctcagcttgagtgtcttcacctgtaaaatgaaaggtgtagaggtttcagtgtctacttaatattcttggtattaaattacacatacaaattatttccaaatggatttgaaatttcatttgtgctagaaagcaattaagtggccatttcggctcctactctgtgacacttatgtgcaaggacattctcaaacttcttaatcaggagcctggatatttgaagatctgtacaagcttacctaaaacaagtacagtcatcagtaagtagagtgcactttattgaacacctgttaggcaccatgctagccacatttcccaactaacctggattcttcagaagaatcttgtaagttctgacagattgtatttttttaagatggatacaatatgtttcatcttacatgttattcttcggatgtaacactgatacttctccatcaagagttgggtttatgtttctgccccttgactaggatggacccctgactatggaagaagttatactatgtgacttccaagactaagtcacaaaaggcaatagagtttctgcttggtactctttgggtcacttactcttggaatccagccagcatttagtgagtgactgcagattaaataaggccacatatacatgttccagccaactgccctggctgaagttccagcagtagccaccaggcatgttagtgaagaagccttcaaaatgacttcagcttcatctactattttattacacctatatgagaagccctgaacccatctgagacccagaatcaaaagagataataagaaaaacgaatgttgtttttataagctcccaagttttgagttgatttgctatatggcaatagttactggtgaacaaggtaagcacacctgtattacacaggtgagctaagcattacacaggtatgccaagagataactgagtcacacaactaaggtcaatcagttgtaacacgaattcttacttccataaagacttgatttgtaaaagaaaaataataaaacataaaaataaaaaagtattaaaataaatgtttgaaaaagatattccttaagaggcccttcctaaagaaggcatactgcatctagcctacatgtggagatccaaacaaactattaatgattacaaataagccgccctgacctgcttaaacaccggaacacagattagctaaattccatccaataattcattcaaattctaggaaccgacaaatcccataaaatgtaataaacatgacttaaatgagagcattcaaatatccttggttcgcaaaaattgactctatttttgtaacatccacagcaatacctctggacctatctctggtatcaagagacaaaaaagtcattttctagaatggttggtaaaattatatatcatctcttccagaaactccaaatatctttaccaaatgtaaaaatggactttcattctacattttttgacttatatttttaagattacattatcatttataaatataatgcaaaatggaagagtgttgatccacgttgttgtaaatatttctttacccttaactacttattgaatgcctgttgtgtaagaaggtgaatggagtctttcccctctaacactctatgtgatagtggaggcttttctcacatacactatgcattaattattttagccaccccatggaaagttgaaagtatctttattttagagatgagaaaactgagtaatagagagaaaatagcatatgcaggtcccacagactagattcctattatactcctgttttcatcttaatatcttagctatggaatattccttaatgttcttcgaaaagtttaacaccattaaaattcttatttacatcaaaataaacatgaatagaataattcagaggacaaaacaggaaatgtatttgggacatggatgacagaaaatttcctattcttatttagaattatcacttatatgtcaagaagaaaaataacattcccacactattcaaagctttttttaagcatcaatttcctaacctattttgataggtaactccatttgtggagttacatctttgtaagatttttttgaagatcagaaataataaatgtaaattacatgctaggcatttaacatatttcctaaatgcagacacacctagtggaataaatgatgtattttggttatactatccttataaaattttcatacttaatgagggctttaccttaaataactttttgtttttaagttacttacactaaatcatttttttaaaaacctctaggtttttggactataacacaataacgctcctttaatcttcataaagagaccactatgaacaattttacaccaagaaactgtaatctaaaaacatggttaaattcctagaaacataaaacctaccaaatctgaactgtgtaaaaatggaaaagtctgaatagatcaatacaagtaagggattgagtaagtaatttttaaactctcaacaaagaaaagcaaaagacgaggtgacttcataagtgatttctatcaaacattttttaaagaaaattaatgccaatgcttcacgaactctttgaaaaaactgaagtggagggagcacttccaaattcactttataaggtcagcattaccaaagccagaaaaagacatcccaagaaaactgcaactcaatatccttgacagatatagaggcaaaattctcaacaaaattctggcaaattttaacaacacattaaaaggatcatataccatgaccaagtgagatttatccttgggatacaaggatggttcaacatgaaaatcaattagtatgatacaccacgttaacagaataaataagaagtcacatgttcatttcattagatgctgaaaacttgtttggcaaaattcaacacaatttcactatttaaaaaaaaccattaaactctcaacaaactaggaatagaaggaaattgcttcaatgtaaaagccatatataaaaagatcgcaggtcatatcacaacaactgcgaactgaaaggattttctatgaaatcaggaacaggaggaacaaggtaagtatgcccattcttgccacttctaccgatggcaatactggaagtccttgctagaataattaggcaaaaaaaaaaaagtaaaggtatataaatcagaaatgaagaatgttattcctatttgcagatgacataatcttatgaatagaaaaccctagaatccattaaaaacactagaaccaatttaaaaatcagtaaagttgtaggatacaaaatcatcatacaaaaattagttgagtttctaggagacaaattccattcacaagagcaccaaaaagaaaacagtaataaactaaagaggtcaaagagtatgtactgaaaactataaaacattgatgaaagaaattaaagatgacaaaatcaaatggaaagacatcctacattcatggatcgaaggacttaaaattgtcattacattcaaagaaatctacagaactaatataatctttatcaaaattccaatggcatttttcacagaaacagagaaaaactctgaaattcatatggaaccacaaagaatcccaaatggctaaatcaaccttgagaaagaagtacaaaattggaggtatcacacttcctgatttcaaaatatattactaaactacagtaattaaaaataaattgtattgtcatgaagacagacatatagaccaatagaacagaatagagcccagatataaatctacacatatagggttaactgatgttccacgatagagccaagcatacacaaggaggaaaggataatctcttcaacaaatggtgttggaaaaactggatatccacgtgcaaaataatgaaattggtgcttatcttatgccatatgcaaatatcaactccaaacggataaaatatgtaaatgtaaaacctcaatccataaaactcctagaagaaaacattggaaaaatcttgtgacattcatcctcgcaattatttccaaaagcacaagcaataaaagcaaaaaaaatagaattaagactacataaaactaaaaatcttctgtttagaaaagggaacaaatcaacactgtgaaaaggcaatctatggaatgggaaaatacaaaccatatatatatattatgagaattatttctaactcagagctattaggagggttaaataaaatgaattatataaagaatacttcatggtatagctacattctaagttatcaaaaagacagcaaccaatatcatgattactattttaaatacatcagggcttaggtaagattttgtgatcagacctgaagaccttatattatattaacaactggttatcttctaaaatatataaagaattcctacaactcattggcaaaaaaaaaaaaactaaaaacgcaattaaaaatgggctaaaggcttgaacagacatttctccaaagacgacacccaaatggtcaacaggtgtatgaaaatatgttcaacattatgaattatcagggaaatgtaaatgaaaagcagaatgagctatcacatttatacctgttggatgcctactattaaaaaatggattagtaaggatgtggaataattggaactattgtacaccgttggtgaagtaaaaaatggcatggctattatggaaaataatatagttgctcctcaaaaattaaaaacagaactcccacttgatctagcaatctcacttttggatatttatccaaaagaattgaaatcaggatcttgaagggatacctgcaatgccatgttcattgcaacaccattcacaagagccaagatgtggaaacatcctcagtgtccactgatggatgaggggataaagaaaatgtggtatatacatacaagagattactattaatattcaaaaagaaagagatcctgccacattaacaacatggatgaaccctaaggacattatgggaagtgaaataagacagtcacataaggacaaacactccatgattctacttataagaggtatgtaaaatactcaagctgatcaaatcagagagtgaaatagtagttgctagaggctgtggagaggaggaagtgggaagctgctaattaacgaaggttcagctatgaaagatgagaaaattctcaagatctgttgtacaacttgtacctatactgaacaatgctgtattttacacttaaaaatcagttaagagggtgaatcccatgttaagtgttcttacacacaataaagtaaatttcaaaagaagttaaacgataagagtgtaactgttgaaaataacatcatcacatatattcacttcaaggttccttccagttttaaaattctactcagaagtcttcagtgtaccaatttatagagttgagctaaaacctaacaattctgtttctgggtaatttgttcagtcacatcaggatgtataaaggcttcctcgaagcaaattagtgatacttttaatctaaggagtggtctccctggctggcttcccatcctctgtttgccaattactttctacaatatgtggacagtctgagggacaagttgtgccaggagggggcaaaggcagagatagagtgaaaaatctcctctgcctcatcccctcccaacacaggattgctggatgtaaaatcacccagaagtgctttttctgctttataaaaggcattactatgttctgctctgcatggttccaagattgttcctcagcaacctcagaacaaaaaaggatatccttttccttagaatcttttactcggtatattaacttgccgaactctatacaggttgtgagtttgtttataaatcagaatccaggctatctcttctcataaaagtgctaataaaaacataaaaattttctcagatcagaccacaaaatcttatctaacccctgatgtatctaaagtagtaatcatattggttgccgggttttgagaacttacaatgtgcttataccatgcaatgttctttataaaattaatctcatttaacactcctaataactatatgagttagaaacagtttcaataatacacatgaggaaactgaggcccagagttcaagaaattctctgaaggtcacatagcaagtaagtaataatgaaggctcttaaaagtagatgtaggggggcagaagagtataggtaagagtgatgtcatatgagaaagactcaatttgcccttgttagctttgaagttgaaagggggcaatgagccagtgaatgtggtcagcctctagaagctagaaaaggcatggaaatggattctcctctacagcctccaaaaggaaggcagccctgctgatatgttaatgttagctgaatgagacctgttttaaacatctgaactaaagaactgtaaaataatgaatatgtgttgattaggggcactaggtttgtagttgttgcatcaaaaatcgaactaatacatatagacacatgattagttatcaggatgggttaatttaaaagaagtatgtttttgtccctgtggccatcaactattcagggtagtgttttgagaccgagtcttgccctgtcacccaggctggagtgcagtggccgatctcagctcactgcaacctccacctcctggcttcaagcaatcctcatgcctcagcttcccaagtagctgggattacaggtgtgtgccaccacactcgcttaatttttgtgttttcagtagaaacagcattttgccatgttggccaggctggtctcaaactcctagcctcaagtgatctccccgcgtcatcctccaaaagaggcgggattacaggcatgagccactacacccagctcgcggtgtagtttgtttttttaagtgttacaatgagggtagccttcacttttactgtcgtttgaacctactctaatcagcaacacctccaaatacacacacatgcacacaccactgaaattgttcttattaaaggggatataaactagagagagcatgtaactttatcggtcaaaatgggaaagttttaagagtgaataggagtgttagtaattccactgtagtaactgctatatattaggatttcccagacatcgtaccctactgttttcctaaattcactgaataattttcaatcatcatgttatttgaactcatcagcaatatttaatgtagttaggtatcttcctttctctgaaaacactttcttctggattccagaatgccacatctatcttctcctttttctctcccctttctagccacctttttcagcccctttgctgatgcctcatcatatatacatctagagatctcatctgtctacacatttttccttggcaatcttatcctggccgatggatttaaataacatctatgtgttgacttctaaattattatcctcaactctgatcttagaaccccttctttacatgcattcatagcctcataggcacctcaagattaatatgtttaaaactgaaatcctaacgttcactcccaaacctgttccttctacagtctcacccatcttggtttgtggcaactctatttggccagttgcttaagtaagaaacctcacggtaatccttgatttctctaattatttcataagtcacatctactgcatcaggagggaaatgactttgatgaaatattggcctccaattctgctaccagatatgctatgctagaggatcatgaaacagaaaagctcacagataaaattaaaaggctcatatcataccatttattttttttatttatgtatttttgagacagagtttcactcttgttgcccatgctgtagtgcaatggcatgatttcaactcactgcaacctccacctcccgggttcaagtgattctcctgcctcagcctcccgagtagctgggattacaggtgtgcgccaccacacccagctaattttgtatttttagtagagatggggttttaccatgttggttcggttggtctcgaactctgacctcaggtgatccacccaccttggcctcccaaagtactgggagtacaggcatgagccaccacgcccggccttaccatttattaaatgagttaaaaacgtatggcatgagggaagacagcaggaggataataaaattagaatactttcagacacagattgttttgcatgtttatgtgtcacttgcttcaataacagtacctggcacataataggtgattcaaacacaagcgctaaataatcaaatgtatgaatactgctctatgtgtgcgtaacgcaatatataagaatcaccgtcgagaaagtgcagcgtcaccctactataatgagcatgggcatggagttgaataaatgcaaatttgaattcaggttctgccacttactaattaggcctagaaatacaaattaagttggccaatttaaaacagagacaaaagcactctgagctaagggaagcataaaagctaatatggaaaattttggggcacctgtgtgggagaacgagtgatgtaatttggttgaaggaacatgaaatacgtgtgtaatgagcataaaaatataaaatattaatatatcataaatcttttcgaggcagtttaggagagtagccttgttatatggacaaaattaagcgaaaaaaattgtattattagggctctgaataacattaaaaaatggacaagaaacttcataataaacttcacttggagacatactaggtttgagatattagtggatatcaaggtatagatacatacaaagagttgaaaattaattggaaatgtggctataactcaagtaagattggaagtggtgaagacagagatacaatgatcatttgcatacagattgaatacagattgaagccaggttattaaattattattaaattatgttgataaaagaacaagtacagagataagaatgccaagatatttcccatgagtttcataagctaaagaagttggaagaacagaaagagccaggtaatgaaagacacagaatagtcagagaggaagaacccgctgagtgtagaggctgagaaaaatgtttcatcagtggtagaaagttaggagagctgaataaaagccatttgtctctgtgattaagaatacttatttgttgaataaataaatgaagttaaagcagagtgatgtgtctggggagtgagggcatgcacgtgttttccataggggacagtcacccacatggctctctcctcttatagagaacgttatttttctctgtagaccagcaagtaaacactttaataaagctttctgatggaatcagatccagcctgtcttgagttcctttgaagtagagcaggtacagcctgtaggggcagtgaaagctcagtccttttgacacttttgaaataaatgttcttagtgtgaataattaaggcatacacttatcaaacctaactacatgtaacatcatcttctgatatgcttcctttagtgacagaatatatcattccccatcccccatctcttgtgatttgtgctgtgtcttttttaaatgataaacattacatttatttgaatggcttattttaaataaaacaagtaagtgaatttgttgaattatctgtgatttatgacatattatgtatttggtaatatttacacaaaggtagaatgagcagagcctagcaagatgtaagtccatttgtaattacttcattaaggagtcatacctgagcgatgccttaatgaaggtggtgatgaggtgaaaatgtgctaccagaataggcattggagaaaacctagaaaaggcagctcaataaagtgataatgagagggggaaaaaaacccctatatctttgcttggtgtatgctccttaatcttaggaggtggcacttattccttaagtcttggtgatttcaacggagggaatggtgataaattgagtctagagagtcgatggagagtcaagaggtccagaatgagagagagtgagaagagagctttgcaagtaaactagccaaggatggaggtcataactatttcaaagcttagaattttcagctaatgcatcgattaactgccaaataaattactaattaaatgcacaccactatcttaacaaaaaattgagtctccaaaaatgtacacattttttagccgataggatcaggtctatcatttttaaactcccattcatagtgtagttttgataaaaatcacatcctctagcacgtttcgaattggctccattgagcaaaataaatcatttttgttaaaaagtaattcttgcaaatctagcaatcctagcacatttcattcccacgctgtaacatttataaggctatttcttgtatattgggttccatacaatattgaaagggtggaaaactccactgagtcttcctcatatagaaagtactaaacattgccgagaatatgacctggtttcagtgtgactttttcttataaatactacagagcctgctatacacaagtttaaattagcaaaattaaaggagagcatatgaagaagcttgcagttatatttttcttacatagaatatatattttagaatgaatagataaaataattcacttagaatgtatgtatttcctttacgtagatccagaaaaatctccccaaatagtgtaattagcaattttcacagatgtacctacacttttcgaagttacatatataaaacttttcatgagcctcatgttttttataaccattagcagcctttgtcaaagagaaccttagaggttattacataatgaaagtagaaaccattacgggaattcatatttatgaagaatcaacgtatagtaaacctagagaagactcaataacaaagcagaatcacatgagggaatcaataaaacttggaaaaacaaaccagctcttcacgaggagataaaaggcactgaaaaattcaagcaagtaaaagcagtgttagattatcttggaagcagttctctggtttgtacaacagagagtaaatgttgacagacctgtgaaggaaatgggctccgtgtagggtcagaggtggtgacataagcagcctgtgtgtaggcatagctcttgaatcgaggcttaggggaagaagttctctcatatccctgtgctagactgaccgtgatctgcagagaagggtttgggggagtggatagagaggagggggaaaaaccataagtaacccgaaaggactactttccaacatggtagaaaacagaacattaaatggaaatggtgagattcaatgtttaatactaaacatatataaatgatattcgaaattggtatactcccagaatgaaggcacttaatatcatgttggagagtaaatgatctgggaagatatgagcatgctatttagccatgaggattccaaagtaacacaactccaacatttatatgggatggtactcttcaatccggcaaaaacaggcatccataagcaattttctctaaatccaaagtaaataaaaacagaattcatcaggtccataccctggaaaggactaaaaatttcataagctaatacagagctagctcagcaaagtgagagagtttggcctaagagctctccacacattcagcagaaatgttgctaaaggtttcttcactgttgtttgtgcctgagaaagcataggaaaacatccaaaccacccactgttgagagaaagaacaagccaatgtcatggaagaaccccactaaattctatacaattatgtaacgaagaatttcatcatgtttttctttattgtttatttgaaatagtttaaaacacttttctattttcaaaattgttatcctgaataatcaaaatctgactttgtacatcatattgtcataaagtattttttaatgattaaaaactgtatttgcctttaatctttctctagctctttgttctagttgatgaagattttagagtttaatatgtacgtaagtttgcctttcatttcattgtgtgttacacaatggaaatttaatatattatgttctatattcctatgatatggtacatatgaatagtatttttaaaatatgttttgaaatgaatattgtagtcaatgaagcaaaattgaaaaggtttagtctgtctctttttgtacatatacatacattaggctttgtatatatacacgtgtatatacatataagttatatatatatgtgcacgtaatacctaaaaatgcatataaaacagaaaacatcttgaatagtagctgtcctttacacactttacctgttgagaatagtgcatttgatgatgtaactgaaaatgttcttctttagtcactttaggtggccttggcaacatttccacttcctggatggcttcaatgctcacttgttgaggcaaaacttggaagagtgatgtgatgtacattaagatggacttcttatctggataggtggtatcaacatctgtaagcacattaacactacacatcaatttttggtttctatatttgagactctaaaaggataatgaacaaatcaaagttaaaggaagacgatagattaatgaacagtgaattgtccatgaatgtcctccagagactaattagaacatgagaatgaggcctaaaatgtctttccaatttggcagaccaatgagatgagcagtaaagttaatttattttccttgttcatataaaaacttcattccatattactttttcctaagtcaaattgccaaactagcccatctaacagagtagctttcattagataagaaacaaaaataaaagattacattttccctccaatggaaagttatattaacatgtcaattcaaatggtgcactggtaattaaacaaatacacaaaatggtttaccgctttggttctcagtaaagaaacctgataccttttaactgaatgttgctgatattaaagtatgcagagagctaaataagtctctgctgaaatgagtcatgtatccacaatataaattaaacagaaaaataccatataatgatttttactattccgtgtatgttaaaaatatttgtttacattgtggtgcatgggataaagtagaatatcactttccttctcagacattagagacaaatgtaaaagtcccgcacattaagttgatctgacttcatatcctttgccacatccagaaagtgaatgaaacgcagcatttaaagtcaataatactttgtaataacacatataaagtggcagctccttcaaaagattcatttgctacttggcattaaaatttacttactgcactcattccagtgaaccaagatgtaaagtaatcctttatgtgaagtatgtcattagtactagaaatgttaacacataagttctgactatgaaatgctagcatttcattgtcatcctttttcatcctttaaaaagaaggaaattttgtcattgagacagcatgtgtaaatctggaggatattaagtgaaataagccaggcacagaaagataagtaccacatgatctcactaacacatggaatctaaaaagttgaattcatagaagtagagagtagaatggtgtttaccaggggctgtggggcaggggttgggaagatgttggtcaaaggacacaaaatttcagttagataggaaaaataagttcaggagatctattgtacaacctagtttataacaatgtattgtattcctaaaaattgctgcgagagtagatattaagtatactcaccatgaaacatgctaagcatatgaagtaaaacatgtattaattagttcaatgtagccattccagaacgtatacatatttcaaaacatcgtgttgtacatgataaatgtatgcaattttagttttttaatcattaatgaatataaaaatcaaagataaaagataaacataaatcctggcaggaggtcaaggtaatgtggcaatgtattttccttgccatacaatttatcttagcttaactactattaagatatctgtattcagtatgtatattctgatcaggtgttctgattataagtgaaaaagccaagagtaaagtctcaagtccgttagcacaaaagcaggttgaacaagtgacttcatcaattcttttgcaagtatcagaaccatgattaatcagaacagctatttttaaagtatttttaaaaagagttacaagagacgaaaaaattaatgttccttggtctacttctatccgtagaacaatacagtgcttctcaattcttaatgtacatatgaatcacctggggatcttttaaaactacagaatctgattcaatagatcggggtagagcctggagctctgcatttgcaatagtctcccaagtgatgctgaaactgctagtctgctacattttgaataagggccaaaaacattacttataagcagactgttacatcatctcccgttttattgttttattcatttattcaaatgatattagacatttcaatgcacaaggctgaaaggtacaaagttatacaacacatatggctcaacttattacactttaattattaatcaacagatggtcaaagtaatttttgcaagtactttttaaagaagaactaaataatattttgtgcatgaacactgccttccttaataatcttacaaacttagctttggaattctgaagcctagaaatctccaattcatttgataattgtttttcaaaatatttgaccaattgtttcttatatagtagatactatacttcaccgtatcttgaaattctagaaaatgttcttccttctcactagtaactagtcagctgtacctgtgattagcataacttagagctctttcatttttagtatattaaataaaaccatgatgtgagaaaacaaaaagggttgagcctgtgcctattcactgctgtgttatacatagacacatgcatgtatgtttggtctcaaatatatgccattataaaaagtaaaaaatggtgaaaaattggccaagcattatttttattgccccccaaaaaatttcaaacattgtaataaatttcatttacataaaacatgtggactaaatgcagctgttcataaatatcagtcattacaataaatatgcacttatttaaccaaactattgccattttgccccaaactattactatcccacttctgagattatgtggaattcaaaactgccagtaggtagaaataagtaatttttgaagaaaggaatttaggtcttctaaaatattttgaatttcatcaacatacattttcaagaaatctattatattcaaagtattttaatggattatccaggaaatttgaaagatagaaaattcatgaattctgcttctaatttggaataagaaagtaaataatagaagtacaaagtaattgcattgctgaacagaatttaaaatgtgttcctctaattggcacaaccagttgtttaacatgttcagatttttaaaatcatataatattggaggataaggcaattctctttaaataggaaactgaattaattatgcataggatttcaatagctggaaatgagggaatggggaagagtattcggggcagtgggaatatgtagaataaacatgcagaggtagggacacattagcgatgtcttggcaacagtggctttgtgtgtcttagagagagtagagtagtgaaaactaagatgaaactggtagattgtacatagaaaactgagggatcatcaacagcaaactagaaaacctggccttcattcaatagactagagagtaaatacttttcaatgagagggtgacaccatcaaaattttattaaagtaaattctttaagtacagaatggattgctggaggaaaacttgagagaaataggaggctaggaccataatccagatataaagtgttcaagatctaaggtacaactgtgtacgggggaaatgaaaacaagtcaatgaatgacaaaaattctaagatggatcaaaaatgacttcattcaattttcaaatcatttactccacagtctttggaaatgcctatatacaaagttatgtgctacagccttaggatataaagattaataaactgacaataaaacaaaggaggaagaggacgaaagaggacactgattgttctgcagccatggtaacaagtagacaccaacaaaagtttcaatctaccctatttattcatttaacaattagttcctccatgattcttatcatgcttcccccagccaaccagcagcaaacactcccttctgaaactttgccagagtggattcacttcaatgaagataattctcaaactaattaacaatggtctcacctgagttaccacgcttctaaagctatcatcatcctattcccaatctgaaatgttcttagattgctggacttctgactccccccgcaaaacctaagaatacgctcctttcagagactgtggttgaccaggagcattccctcttatttaagatgttatgaagcccaaatccaatgtttagtaaaactgtaaagtttgttgaaccttaataccattactatgttgcatttttttgtcatttttgtcatatttttgctgtttctatcattaacacaaaaacaaacctagttgtaggagaccatttgtatactattaacaggaagccagaagaatttacttagaaggaaaaagcatttatcacttattccatatgtgctaagtgattgtcatgtgctatagaatatacttagactatgttagattatgagtatatagcagatgagccaccccataattataaacattactttttatgggaaatcaaaataaatgttatggacttcggggtaatcctcatttatgatgactgcactaaggccaattcctggcactctgtgatcacctaagtatttgttaagaaactcaatacagaggacagttaaagtcatagaaattgatgagaattatgtaagacagtgactaaaggcaatggtatgataatgagtactataaagtatttgaggagtatgaaaatgatgggatgtaatttatacttcttattacacgacattaagattttatgaaatgagagcagtggctgaatccccaaagtaagaacttaacaattacatgaacgtaattttacaccaagactctactacataaaatgctcacggacaccagattttaataattgcttatccaatctttgaagccgtctcagaatgaaaatagtgagaactcacaatactgctagagattttactttatgaacaataacaccgtttctgatgagtgtttcatatttgaggatactatggaacaaataaatcatttagcgaaatttgatcatttttcgaataaagaagttgaacctcatggcggtctgaaggcaaattcaaaggctagtcaaaatcagattagaaaccagtcattgcactacactgccatggtaccttaacctcattctctcagatactatctcagtgtatttgaagaccaagtatcgcacaaagtttgctttcaacatgccctcaccccaagaaagtcaatgtgagtaagtaagatgaaagcagtgccttcaacaaaactaatcttgggcagtcaacctcagggaagtccgattagccagtcgctgggtgtaaccttcaaacaccgctgggaaatctaaagaagaggctctactgtctaaatttcaggccaagtttctgccaagggacaggcaggaatggaaatacagaattataatgcatagcatgtgtaattgaaaacaagcaagatttcaaagatagcaggtataaatgtgcactcacaaagctttagttggtcagtcttttaagagttttattaaacaacaaaaactgtgagaggatgtcatttagaaaccatgatgagcatcaacctccccacagggtttgtattaggaaacaaaaataaataaattcactgagaagaaaaggaatagagaaactggaaagaaggcacttctggtcataaactagccatagccagaatgctcaaaatatgaaaacagaaaggcctatatgttggcacaaccaaaacctatggttgtaaacaataacctaattcattgatgtgatattctaaaaggacaaagtgctggaagtaaagtggattattttttgaggcttgcatacgaagagatttatgttataatatcatctgatatctaaatgctggagtttctaagttgtagaccatatcatggcaatggactaattcattaaagcatgatattgttatttttaatattttgtatttggcattcagcactgactgcattgtacatacatgtattctctacttacaagtcactatatacaatagatatacaacattttaattaaaatttgcacaactcctcccatgttaaattttttaacattctgcaagatatgttctgccttagctaaattaagtactccttaattaatccatttttagcacttcattcactgatacaagcagttgcttttaccatttagtaacaatgcttctcattaaaggacggtaaaatgtcataatggaaataatttgcgttgatgaagatgattgaatttcatcataaaattaataacgataaaaagtaatggcctatatttatccaggagaaacacaaaacaattttatcttttgcactttccattacgcttttcaacatgcttatggtgtaactagcagaaaactatcaccatcatcttgttacaagtagaaaacagtggctcaggctgggcgctttagctcatgcctgtaatcccagcacttcgggaggacgaggcaggtgcatcgcctgaggttaggaatttgacaccagcctggccaacacggtgaaaagccgtctcaactaaaaatataaaaatttctccacatcctctccggcacctgttgtttcctgactttttaatgatcgccattctaactggtgtgagatggtatctcattgtggttttgatttgcatttctctgatggccagtgatgatgagcattttttcatgtgttttttggctgaataaatgtctcagggatctagaactagaaataccatttgagccagccatcccattactgggtatatacccaaaggactataaatcatgctgctataaagacacatgcacacgtatgtttactgcagcactattcacaatagcaaagacttggaaccaacccaaatgtccaacaatgatagactggattaagaaaatgtggcatatatgcaccatggaatactatgcagtcataaaaaaggatgagttcatgtcctttgtagggacatggatgaagctggaaaccatcattctcagcaaactatcacaaggacaaaaaaccaaacactgcatgttctcactcagaggtgggaactgaaaaaagagaacacttggacacaggaaggggaacatcacacaccggggcctgttgtggggtggggggagtggggaggggggagggatagcattaggagatatacctaatgcgaaatgacgagttaatgggtgcagcacaccaacatggcacatgtatacatatgtaacaaacctgcacgttgtgcacatgtaccctaaaacttaaagtataataataaaaaaaaaatgtaaaaattagctgggcatggtgatacacgcctctaatcccaggtgatcccagctattcgggaggctgaggttagagaatcgcttgaaccagggaggaggaggttgcagcaagctgagatcgggccactgcactccaccctgggtgagagagtgagactccatctcaaaaaacaaacaaacaaaaaattaaaaaagaaaaaaacagtggctcaaaatgcataatgcttgcctagagcataacagggaaaaaaggaaaatcagatgcttttagaagactgatacactgaaaactatttgagcgttctgttaatcaataaatcctaaacctaccaatacaaatggaacttatcatgcagccaatccagtaaataatggtagctggaagtaatgatagtgattgtaaaaactatggctgggcatggtggctcatgcctgtaatccgagcactttgggaggctgaggtgggcggatcacctgaggtcaggagttcagagaccagcctggccaagatggtgaaaccccgtctctattaaaaatacaaaaatcagccgggtatggtggtgcatgcctgtaatcccacctactcgggaggctgaggcaggagaattgcttgaacccgggaggcagagatgacggtgagccgagatcacgccactgtactccagcctgggaaacagagcaagactccgtctcggagggggtaaaaaaaaatctatattgaaaatatgagacacagaaaaatatactccacaaacgtttattgagttactttgtgccaggctatattttagactttaataatacaatggtaaataaatgatcccagagatatgttctcatgaaagaatgactgtaatgggaaaggaagttacgaataaataatttcaaaattctcagtttaccacttgccactgtatccctgcttcattgaattgccttccataaaagccctcttcgctgggatagtttttggaaattaaatcagaatggaagctctgcagtgttaataccaaacatcctgagagtgcctcagagcaaatgcacagaagctggtggggaaaagtcagttaaatgaaaattcgcaaccaactgtgactttaggagttttaaataagacgtgtttcagttgaaaagtttttcaaaaatcaaatttctgccgtgtgccctaatcaacaggaaaagttctatctttaaattttcaatttccaaatgcaggaaattttcaaaattgtctcttccgtcacaattgtcctaagtttacatatgttaaatatattttatttgaaaaatacatccttgactatttaaatccttagaacaaatatttggtatgtaacttctaaacccaggagaacagacactaacttgacataacaaatggaagctactcagtcagcatgggagactacagatagaaaaacatctgtactttcttacaattctctcgacatgcctgttgtgggaagaactattagggtttacatttgagatgaaagtattttgactcagtgacatttaactctgcttaagtgattgtcacctgcggttttcgtgctttgcttttgacctaaccaaattgactttttctttcctctgctgctagaaaaagtatagtcagtttcagaagtaactccaccccttatcttcctcgctaacataaaatagtctatttgtgaaccttaattgtttacagtgttagaagttatacttgatacacagtgaggccagaataaagatgtttatttcatgtgacataaatttaattggttattattctttctggtatattttgggatttcaaaatatgcctgatggtataagggcagtcctggggcaaattactcaatgatgactagcttaacgcagatattgtacaaaatgatcaggtttttttttttttgaaaaaaatatggtaaaaatggacccactacatataaaagagcttagcctgttgaggcaaaaataccttgatcaaatcctgaccctatcactaataggtaagggactgtggtaaaattcactaatttccctgtcccagtttttatctataaaatgagtcatattagtatcttgcaaataattagggatgatgttaacagagaaaatgaatgcaaagtaaatgctcaatatatacgatctattatttttcctgatttccttccaattggcacataattgtaattcataggtttgcttgcattcatgccttcattaagtatttgtggaatgcctaccatgtgtcagacatgataccaattcaccaagcaattaatcacgttttataattagaatggctccatttcctaattcctaaggaagaaacgagtggaccattggacaaaccagatggcatacaacactgatgtgactctctcagcacaaaacatttatgtgggatggtgtcatggtggtatcatatgtcatacgcaacatcagaataaggggttcagtgttgagcaaaacaccatcacacacaaacttcaacaactgacaaaataactgatggcgaattaagttttcctgaactaatccaaagttttcagtagtactctaactgaaaactgaaaccagtggacgaacatcacgcatttgtgtattttctaagcactactggaggcatgctgatgaaacacacccaatcaagaagtagcaaactttaacccattttcaaattacaaagatacattttccttttgacagtacttatgaaatttcatttgagtttggagtttctggcttccaccattgtaattaggacctcccaactacaaatacaataatatccatggatgtcaagtaatttccaatgtgaaaaaaatgcaatttagaaatttacagaagtgaagataatcaaatgtgaagcattgatggagaaaggtacaagtgaaaaagagagtaagcatccaaaaccatgtaacacaaatatgatgatgataagggataactttataaaagagaatgtaataaatgatgttaagaatgcgtaaaacatagctgagattgattttcattaaaatgtatatactaaagtatattttttgaatagtgaatagaatttgatgtatgtgttaaaagacactgccttccatgcctgtaaagtacagcatgacccaatccttcacacttagctaaaagcactctaatgtcatccctctttctctttcacacattggtcttgttttgtttttgcatctcaaataccgaaggccattttacacctcttgatcttcatatttggtgctcttttacctaaaataatttctctttttgcatttttgattcattctcacccattaggtcttaactcatatggcacctcttcagagatgcatttcctatcccatttaaagaagcccaacccctttccctttattttacattgatttcctttacattgcttgtcacaaactgtcattattatgtttattttttatataagaatataaaaaccacaaaggcaggaacttcctttagattgttttaccaatgactgagaagtagtaggtactcagtatttgttaaatcagtaaatgaatggagagagaaccttttgggaataaaggttcattttcatggtctacaccccctgaatgtagagtaagacacatgttgaaaattgagcactgcttgaaggggcagaaagcacatagcaaggaacaggagcagcctgtatttttctccctacaaaattctgcaaaagagattcagtttggtatagaattagtttttatcaagtatcaattatatacaagaacttttattatgtttttttttcatttaaattcaccactctcttgtgagttaagaatacagcccaaggtcatacaaccaataagtgacagtctgattaaagtggaaaaaaaaaagtagagtccttggtttggctcccagttctttcattttgtgaccttggataaagttaagcataatgcacctcagcttcctattgtattgcaagaagtttttcttattgatcacatttccaaaaataagacttgatttgaagaacatctcatgctctagaaactgtatcagattatttttaagtgatagggaaagaagcattaatttccaaattagagagcattagcaggttaatcaagaagcctatgagtgatgatgacaaagttagtacattttaaattcagattgaaaatactcaagacacaggaaaactaatgttttattcattgttctaaactttggcatacacactacaaaatagcaccgtgctttacaaaaacgtattttcaaaaataatattgactgatatctacagaaaaaaaaatgtactcaagtgctctcagactgaggataggaaaagcagactccttagaactttggaagcatagcttccaaaaattttgtgctaagcgtctgcatacctgggggtttgaaagattcaagtgtgtgaattccttgtcatctcactaaaactatgagtcagcggtgggtaggattctaccaaataatgataattgtaaaaaatgctttttaagctcagatatatgagaaagggattcaataaagaaacaaaaacctaggatggtatacacacatttataaacaatatgatcactaatatataactataatatgcatgcaaacattacatatttggaaagcaactccctttgactagatattagcaacttcaaagactaaatagagaaaaggaaaggctttgcgtagaatcttactgctattttaattactgaatgttccttttgtccatttgcaattttaaaatttcttctttccttttctcagtggctggatgagggttaaaactgatatgctaaataccacataacccattttcttggtatagcttccagttcttcttgactctgaaatgtcggcctctctcaaatacctctccctcaggtagagctctactagcaggggcctgtctttcctgatgaccagaaacccaggggcttggtataactatctcaattactatatcctatggagcctgactccttatcatagctccagtccccatatgggctctgatcttggattgaccagatgggtcatttccactcttatctcaatgggaacgtgccccttgattaggaaagctttccctcagagaaaacacatcccattgacggttttggccccaagagttcaaccgttagttgtctttgatattttaatttcataagtctggatttaatctctcacttttaaacattttattacaaaagccatacatgcttattgtagtggaaaactaaaacagtacagacgcatttaaagttaatagtgaaagtaccccatatctctacagcaccacagtcccattagctagaagtaatacttgtcaccagatgctatgtcatccatacatccatgcatctatccattcagccattcttttagctatccatttatcatactcatctgcctgtctaatgagattaaacatatacactgtctatgcatgtactttcttaagatgtgctcaattagtaaagattcaaaatttagctttaccactcactggtattatgaatttggataagaaacttaatttcttcatttcttcataccctcattggtaaaatgaggcaaagacttttccaagaaggtaagtgcaagtaaggcatttagagcaatgcctggcataaagtatgttttcagcaaatttcaagtttaaaatgtatatacacatgtatatatacaatgtgaacttcaaaattaatttcagtaatgcatgtattcatttatccatttatttattctgtaactatttattggacacttgccataagtcgaggattatgctggacactgcagctgaaatagtgagcaaaaataaaaacaaacacaaacaaacctagaccctgattttatggtgcctatagtccaatggtagagatatatctgcctaacagtccatagcatgaaaaatactggagctactgtgtacaacgctgcaatgaacatccttacacatttgtcgtagatatgtatgagtattactatatatctaattcttaaatgtgaaacctcaggatcaaatatatgtaaaattacatattttgaaagataatactaaattgtctgattaaaatattacaagttgtgtttcctccaaaagaaacacagggcctatttacatgaaccctcataataagaagatatttgtactatgcatttatttattagttaagcttaattttattttgatgggctatttctaattttcccaagtgaatgtcctgaccataatatgtagccacttttaaaatattatactttgtatattcattgtaggagtgttatcatactgaggttattgattttttattactagtgtcattctgcagtccatcataggttttattactgtttaatggtctttcacaatggaaaatattttaattttgtgttggtaaatttgtcggtattttacagcctctaggttttatatcaccttaatattattgtaatattcttctacattgtaataaagtatttaaatgtttattcacattcaatcattatctgaaagttatcttagtatttgttgtgccttgggtttccacagttgaaggctttattagctaacctattctatctctagagacatgaaatgtcaccctaattgtgtactaaatttacctaaataaaagggaatgttgtcaaaatatctattccacaccattaaattatttctctatcatgtcatactatgttaagtatgttataaaatctactaaagcaaatcacctgtttgaaaataatttcttaactgtactcacgcatttacatttaaacaaattttagaattatctagaaaactgaatccctcttaccattcatgtgatttatgttcagtgtgctcaccctgaacataaacaccctttcttctctgcttattctctaagtggctgaccctttcacactgtatctcctgtgatcattagctggctagattccagttgcattaagctggtgggaagtaccagctggagattgaaagaagagggaaagagaaagctggggaaatttctctattatttccctgctccagagctgcataatgtagtatctgagttctaccaacaactacattccctccattggtgcagctttcactgaactccgttccccctttcctttcagctactatatagtaggaatagtagaaatagtaactacttcctactattgctcctctctagattatttcttgtcacctatttgttaatatatacttctgtaacttttaaaatacaattatcttcattttaccatctgagataaattctatttattgctagggttctgttatatcctctaaaataatacaaatatagatacacagagagtcgcatacatacatgtttgtgggcatgtgagtgtgtaattatacagatgctcctcgacttatgacagggttacattccaataaacccattgtccatagaaaatatagtgagtcaaaattgcatttaatacactgaacctgtcaaatattatagcttagcctagccttccttaaacatgcaagaacacttacattagcctatactttggcaaaaccatctaacacaaagcctgttctataaaaactaaagtactgaatatatcgtgtaatgcattgagcacagtagtgacagtgaaaaatggcatgattaaatgggtactcaaagtacggtttctactgaacgcacactgctttcacaccatcataaagttgaaaaatcattagtcaaaccatcttaagtcagggaccatctagatcttgattgaagtaacttcaggaactttagatttaaggggtacaagtgcaattttgttacatggatatgttgtgtagtgatcaagtctcggcttttagtgtacccatcacacaaatagtctacaatgtacctaataggtaatttttcatctctcacccccttcccactctcccatcttttggagtctccaatgttgagtattcaattctgtatgtccatgtgtacccattgattagttaccacttataggaaaatacagtatttgattttctgtttctgacttatttcacttaggatgatagcctccagtttcatccatgttgctgcaaaagacataattttattcctttgtggctcgttagtattccattatatatacacaccacattatctttatctactcatggacacaacttgattccacgattttgctattacgcatagtgctccagtgaacatgcgagtgtgactgaagttactttcaatgtacaaactaacttagggagaactagcattttcatcatatgtgacttcctttcctcatgtctttatttatgtacttatatacaactttaaacttcctataaaaaaaagcttatactttcttgtgcggtttacttctaagaaaactacatagattttggaacttctcttttttaaaaataattttattgtgtgttttaaggtatacacatgatgctataagatacacatgtaaatggttaccataatgaaaccataatgaaagaaattaacatatccatcatctcacataatcgttcccccaccctctgaccacgagaagctataatctactcatttagtaaaaattctgaatacaacacactattaactataatcctcatgttttatattagatctttcaacttgtttatcccacatatttgctactttatagactttgacctacatctccccatttcctccttccacccccaacctggtaaccactgttttattctctctatatagttatacacaatggaatattacttggcctttaaaaaggagatcttgggccaggcgtggtggctcatgcctgtaatcccagcactttgggaggccaaggcaggaggatcacaaggtcaagagattgagaccatcctggccaacatggtaaaagccaatcactactaaaaattcaaaaattagtttggcttggtggtgtgcgcctgtaatcccagctattcaggaggctgaggcaggagaatctcttaaagccaggaagtggaggttgcagtgagccgagattgtgccactgcacatcagcctggtgacagagattccatcaaaaaaaaaaaaaaaaaaaaaaaaaaggagatcttgaccaggtgtggtggcttatgcctataatcctagcacttagggacttagggaggccatggcaggcagatacgcagatcacctgaggtcaggagtttgagaccctggccaacatggtgaaaccccatctctactaaaaatgcaaaaattagctgggtgtggtggtgggcgcctgtaaatcccagctacttgggaggctgaggtaggataatcacttgaaccggggaggtggaggttgcagtgagccactgcactccagcttgagtggcagagtgagacttcatctcaaaacagaaacacaaaaaaaggagatcttcttatttgccacaggacagatggagccgaagaacattaggctaagtgaaataagcaagacacagaaagaaaaatattgcatgatctcacttgtttgtggaaactgaaaaacaaaaagtaactatgctgagtatcattttattaccactgtacatttcctaattttgagatcattttacataatgagaaaatcatattattttcaaataatttatcttgtgctttccaatatatatttcatgtaactttctctcgtcatataatattggctaggttctccagaaaaatactgaacagcgtcaatacagaggaggaatattcttgtcgtatttattgtttgagtcattctagcatattgatatgatttggatttgtttccttgcccaaatctcatgttgagttgtgttccccagtgttggaggaggggcctggtgggagatgataggatcatgagggtgaatttcccagttgctgttctcatgataatgagttctcatgagatctggttgtttaaaagtgtgtagtactgccccctgctttctcctccttctctggccatgtaaggtataagatgtgcctgcttccccttcgccttccacaagaaggtggaaatttcctgaggtatccccagccatacttcctgtacagcctgaagaactttgagttaagtaaacctcttatctttacaaattactcaatctcaggtagtttatagcaatgcgagaaaggactaatacagaaaattggtaccgagaggtagggcactgctacgaagatacatgagaacgtggaactaactttggaacagagtaagaagcacacgttggaacagtgtggagcgctcagaagacaggaagatgagggaaagtttgtaacttcctagagacttgaactgcttggaccaaaatgctgatattgatatggacaatgagatccaggctgaggtggtctcagatgaagatgaggaacttattgggaactgcaataaaggtcactctcgcaatgctttaacaaaaagagattggcagcattgtgcccctgctctaggtatgtgtggaacttttaacttgagactgatgatttagggtatatggtagaagaaatttctaaccagcaaaacatttaagatgtgacctggcttcttctaacagtatacggtcatatgtatgagcaaagagattatctgaaactggaacttatatttaaaagggaagcagagcataaaagtttagaaaatttgcagcctgaccatgtggtagaaaacaaaagcctattttctcggggtggtgggggaaattcaagctgtctgcggaaatttgcataagtaaaaaggaactgaatgttaataaccaagacaaaggggaaaatgcccaaaggcatttcagaaccctttgcagcagcccctcctatcacaggtctggaggtctaggaaggaaaaatgatttcggaggccaggcctagggcctcactgctctgcacaacctcaagacactgctccctatgtcccagacactccagctccagctgttactaaaaaggccccagatgtgtcttggggtgttgcttcagagggtgcaagccataagcattggtggcttccatgtggtgttaatcctgcaagtgtgcagagtgtgagagttgaggcttgagagcatccacctagatttcagagaatgtgtggaaacacctgcatgtccaggtagaagtctgctgcagcgggggagcctgcatagagaacctctactagggcagtgcagaagggtaatgtggggttagagctctcacacagagtccccactggggcactgcctacttgagctttgagaagagggccactgtcctccagagcctagaatggtctctccagtgacagtttgcaccatacacctggaaaagccccagtcactcaatgccagcccatgaaaacaactaagggtgctgtacaccctgctgagccacagggatggagatgcccaaggccttgggagcctgtcccttgcatcactgtggcttggatgagatgtggagtcaaaggaaattattttggagctttaagatttaatgactaccctgctgggttttggacttgcacagggcctgtaacccctttcttctgatcgatttaactcttttgagctaatgcctgtaccctcattgtatcttggaagtaactcattttgattttacaggatcataggttgaagggacttgccttagtctcagatgagactttggactgtggacttttgaactaatactggaatgagttaagactttggggaactgttgggaaagcatgattgtattttgaaatgtgagaacaatatgagatttgggaggggttggggcagaacgatatagtttggcactgtgtccctgcccaaatctcatgttgtattgtgatccccaatattgaatgaggcgcctggtgggaggtgactgaatcataggggcagatttccctcttactgttccaatgatagtgagttctcatgatatctggttgtgtgaaagcgtgtagcatctctgcctgctctctcttcctccttctctggccatgtaagccgtgcctacttccccttcaccttccacagtgatttcctgagacctccccagccatgcttcccatacagcctgtggaactgcaagtcaattaagcctcttttctttataaattacccagtcacaggtagttgtttatagcaatgtgagaacggactaatacacatatcaagataaggacatttattcccagattagtaagaacctttctcaggacttggtaatgtatttaagcaaatgtcattggatatattacttttgcttttactgataggactgactagttctggcttcctgactttaagaaaaggaagaacaaagattaaatattacctgttcactgttttgcattttattattaatataaatatgtcacataaaaacatcaattaaatgaaagccctgaatttcatcactttaaaagactttccttattgctctttaaaatatatggcaaatgtggatggaagtacacacttagcaaataattttgtcagctaaaactttttattccaatgttgactcaagtgtaaatagttaataaccttccatatttaaaatgctccattaggtaaataatctgtaattggtgcctctttatatcggggaagaggctatattcttggtagcaaaatagtctgattcaattacctacatatatagttactcaactagagaaggtaggcaaataggtgattcacaaacactaaacataactggacatagttggaaatactatgaatcacccatgcatcctctatcatgattatcatagcagtgttcctcaaagtatatctcaacttatcagccattgcatccacataatctgatgaattgaaaataataattaatataagatagactggttggaagcaaatagcttcaaatagaaagtattacaaaggttcagataatcttaatagagctaagcttctagaggtttacatgaaccaaataaaaatcagcactgagctttcatattccttttcaatttctcattatcaatttgtttctctgtgtgagtgtagggtgatgaagaatgaagtagatgaaattttcagtaaagtatacatatgttgccaagaaatcagaggcaaataattctataactttgggtcattgtactaaataaaagagaaaccttagtattgcaaagtttaaactgattatgttaatatgcatttgcctccaaatattatagtaaaataatggaataacaaaatttaattctggtggaaatattttggatattgtacagatgcacatgatgctttgagcatattaaatgtagacttacttttgtgttcttatttaagttattttcactgcttggaatgcctgatactttttttttcatttatttagctgaataaatgtacatttactgttatcagtcagtcaatatccaaatgcttggtgtgcagttatttcccagaatacctcaagagcttggtacacaatgcccttttccaacctctgaacgtttatcaccagatagactctatcatataatacgttgttatcccagcttgcatgtgcacacgtgcacacacatactatatgacctgacccattagaattcattcattcatatatatatatatatatacacacacacacgttttaatattaaagtaaattaaatatattaagtaaataaaatacacaagatacttacaagtaaagcaaacaagacaacattactagcatttctttgactgtttctatctgacagagccactcaacactcgtaacacctattatacgagtcaaatcataccttacaaaagagtttttgtctaccacaattctttattgttgttaccttttctaatttttttcagaatgggaggggaaacaatatgaactcctagaagacaatgcattttaacggtctaataccaagactggctcattttgcacccattaaatgcctgtgaaaaaattgaccaaaattggtcacagatggaacacatctcattgctcttcttagataatttctattacttacattttcttttacaatcgtttttttacttagctcacatccaaatgagcaaattacattcatttggaaatgttattcgattcacattgtttgcccccatggggatttttttaacgcctttttagaaactacttaaataggtcctaaatttattatcttggtccatgggtgttgaataagcaaactgagaaaatcattgttacaactgtcaattctacattaaaaatgatgttaaaatctggtcatacatctctggatctgacatattttagataaatattagaaagggttaagtagctgaggcgatagacattttaactagctagatcaaatctttctcataatgtatgcatagatcaaaacactacattttaccccattattatctgcttttatatttttttaaaaaagggttagctgtatatcgaaactctaaatttatttatcccacataactgcaagtttccatgtacacattgacttatttcctcaccctcactactcctggtaatcaccattctactgtctatgtattcaacttatacattttcttcagatttcagatgttagataacgtagcatatttttttctgtgtcttgcttatttcacttagtgtaatttccttcaggctcacctatgttgttacaaatggcactatcttttgtgaggctgaatatttgtgtgtgtgtgtgtgtgtgtcacaatttctttatctgtcagtggacactcaggttattttcatatcttggctattatgaatcataacgcaatgaacatgagagtaaggctatctccacaaggttctgatttcattttctgtgggtctatacccaggagtgggattgttgggtcatatggtagttctatttttaactttttgaggaaacactcccagacaattttccataatgtctgctctaatttacaccgacaccagcagtatgtcagggttccctttcctccttgcctttactggcacttgttatctcatcttttagataatactcatcctaacaggtatgaagtaataccttattatgattttgatttgcatttccctaatagtgatattgagcacgttttaatttccctgttggccgtttgcacatcttctttgaaaaaaaaaatgttcaagttctttcccaattttttaattgggttatttagtttgtcactatggaattgtgcaagttccttatatattttggatattaaacccttatcagatatatgttttgcaaatatctactcataatctgtaggctgtgtttttcttttgctttccagaagctttttagattaatgtagttccactagtttatttttgttttcttgcctgaaattttgatgtgatattcaaaaaatccttgcaaaggcgactgtcagagagctttttcctctctgttttcttctaggagtcttatgattttaggtcttatatttaagtctttagtccattttcacttaatttttgtgtacagtataagacaagggtacaatttacaacaccatttattgaagagactgtcctttccccacatatcttcttggtggtcctgtccaaaattagttgattatataggcttaggtttatttgtgagatctctattctgttccatcagtttatgtgtctgtttttatggcattacaatactctttttaatactgtagatttatgatataatttcaaatccaaagagcagtatttccaacttttttttcctcaagattgttctggctatttgggatttcatgtaagttttataatgctcttttatttctgtgaaaaaaaatgccatttagattttcacagggattacattaaatttgtacagtcaaccttctatttccacggatgcaactgtagaccagaaataatcaaaaatagaacaaaaaactcaatacaacaacaaaaaatattaatacaagtaaaaataatatatggtaacaactatttctatagcatttacattgtattaggtgtaataacaaataatcgatagatgttttaaagtatataggggggtgtgcataggtatatgcaaatactatgccattttgtataagggatttaagcatctttggattttggtatccactggcatcctggaacccatgtcccgtggataccaagggacagctatatatccatttgggtagtatggaaattttaacaatattacttcttccagtctacaaacatgggatattttcccatatatttaccttttaatttgttcctcaatgttttatagttttggttgtacgtatttttcactttcttctttaaattgggtcttaaatattttattctatgttatcataaatagaattttttaaaattttttggatatcttttgcataaaaatgcaactaattttatgttgattttgtattccactacttactgaactcatttattagttctaacatttttcttgtggagtccttaggggtttctacatatacgatcataccatttgcaaacagaaataatattacttcttcctttcagatgtgaaagccttttattaattttgtctcactgctcctgctagtatttttggtactatgacaaatggaagtggtaagagtgggcatccttgctttttagcaaatcttaaggggaaagctttcagtacaaccaccccacaaccaccgttgatcatattagctataggcttttcataaatagccttgatgttgaggaaatttccttccatacatattttgcgaagagttataataataaaaggatgtttagctttatcaaatgctttttctgcatgtattgagataatcatgtggtttttcatctttctgttaatgtagtatgtcgcattgattgatttgtgtatgttaaaccaaccttgtgtcctagggctaaacccacctggtcacggtttataatccaatgtgttatttgtcttgctaatactttattgaggactttcacatctatattcctcctagatattggcatatatatattttcttctcttgcggtgtctgtttgactttcgtatttagggtgatgctgaagtcataaatggctttggaggtatttcctcttctattatttagaagattttaagaacaaatggtataaattactctttaaatgtttggaagaaatgaggagaagtaggtcaaaggacacaaacttgaagttatattggataaataaatctcgataactgcttagtatgatgactacagttaatggcattgtattgtacactgaacattagctaagaaaagagactttaggtattcttaccataccaaaacagttattatggaagataatggataggataatttggttgaattcagtaatcatttcattatgtctatgtatatcgtaacatcttgtaccccttaaatcaggggtatgtaatcttttggcttccttaggctccatttgaagaataattatcttaggccacacctaaaatacactaacactaacaatagctaatcaactaaaaaaaaaaacctgcaaaaaaatctcataatgttttaagaaagtgggtgaattacagttaggctgcattcaaagctgtcctgggccacatgtagcccatgggctgtgagttggacaaggttgccttaagtacatccagtaaaagaataaaaactaaaactaaaataattagcacatattgttgtatttcaaatgatgacaattagattcgacagttgacaagtcaaatataatacatttaaatggtgcaattctacttcttgaggaaatcctttcaaaaaattggtccaactggaatgtataaatatacaattaagaattgtgcatttaaaatcaaaagtaataataaactctaaattaaatcagacttttttgctgaaactaaacgaggtgaataaaataggtgaagtgaacctaatttataaggctgttatggctcaaattcttcaaataaatttctgttcagttcttatcattttcataaagttgatttatgaggaactatgcaaatctagagtagtctactaaagtctgctttttatatgcttatttcacacaaaatggttattgaccatatgtattttgtctaggcccttaccaagaggagctgttaacataattgatttacaattcagttaggaagaaaacatgttaaagctaattttactctgaaacaataaatcaacccaatgtgaagtatatcacagcccataaaatgaacagtgatccaattgtacagttgaaccatgtagctcacatatcccatggcacttaaaatcttcatccagtcattaaataagtctcaagatccaaaagatttacataagcacaactgaataactttattagctcttctcttctgggtttataatgatgaactaaaaatactaacctgttataaattacatcagtaatctttcagctctttttctcatcatattataaatttacaatgttactgagattaaaaaatgtttatcatatgttaattatttgcatgatctttagcatttttaaacaatggaaaaaagagagctaccaaaaccagagttgtgttcttggcatcagaaagctctagtaaacatcaaataaactttaacagcttagtgcgtaaataacacagcctcaagtacaacaccttagccacagatagtacttaataaatagtcattgtttggttgtatctgtgtaacacaacagaagaaagtatacaatcctaatccttgctttagaatctagacattgttttcttagccatttctgcaataacagttaaaataaacgtaccagcatttctggtaaagactctaatatataagggtgttccagaaatttcaatatactagatttgacagtatggcttgagagagggatcccactgctgagcattctctgcctctcatatcatggatcatagtcacttatgaaattttatctataatattgtagtccataggtatatatatgtatatgcatgcatgtgtttatatacatgctatgattctacaaaatacttgacatctttaatgaccgcctataaagatacacatgggctgaaaatggatgaaaaaagatattccatgccaatggaaaccaaaaaacagcaggagtggctgtacttttttcagacagaacagatttcaagacaaaaacaaagagtcaaaaaaggtcattatataatgagaaaggggtcaattcagcaaaaggatacaacaattgcaaatatttaggcacccaacactggagcacccagataaataaagcaaatattattagagctaaagagagagagagatctcaactcaaaggctgagtagggtactagggggtggaggtaagctggggttggttaatgggtacaaaaattccttagaaagaataaaacatagtatttgcgagcacagcaaggtgactatactcaataatttaactgtacattttataataactcagtatcattggattgtttataacacaaaggataaatgcttgagtggatggataccccattctccatgtgattattatttactgcatgcctttatcaaagtatctcatgtactgtctctctctttctatacatatatacacatacaaactatgtacccacaaaaatttaaaaaattcccctggaatatatgcaatttctaataggtatatctcttaatctaaataatgttttgaacattctcatatacttttatccaatatatatgttacaaatttattacagctgaagaatctacgcaatcttaactttctatggaggcaatgacactactataaactatttatgacactgcggggttagcaaatcaacccatgaacaaatgtcattttctcttttgatcatattattagttcgatagataaggtcatattcacaatgtagcttatcaatgtctcccataataaattcacagacaaaattttgaatctgtactaaaatatagtattttaaaaacacacatgtggcagcacaccctatccaaaaagtgatggcaaatggccttgtgtcagtttaaagttatatctacttgatggtcatgtgactctcatttggactgcttccaccaaatataccttgccaatgatcttggatcttaaggcataaaaatacagctattataataaaatattttactctcctggaaagggtagcttttactctttgtaataaaattcagctatggatgtcttagctataataatatcgaaaccagtaagataaaatttaacagatcacctttaagtctgaaattaatattggaaagagcagttataaggactgcatgggtttataaattatttgtgggaagttttttttattatttatgactgacatgataattatacatatttatggggtccaacacaatgtttctacacacagacattggatgtgctaattaccctgaattaattatcacatattcaaagaaattataaatatataagatgatggattcagatattatttgagaatcaaggcaattcaaattctaggcctaacgtttactagatgtaggagctatgactaccatgacgataaaggacaccaaaagtgagcccaataataaaggctgtgggtattcatcttggagatggtagattcataaagaccttttcaaatggttaaaggcagtcatggttcctctaggttgaagtaaaatcaatgtgtgaatgttacaaagatactgatgcttctttaatgtgacaaattttaggcatgatatcatctttaataattataatagactagcaaaaaaaagatctgcttcagaaacacttccaactggtacaaaaattcagttagtgaatgcatagatatctctaatctgcactagagaaggtaatctgcccagattggcttagattacacattgtgtcttatgttcgcacacattatctcatttgctcctcaaaaaatactaaagtaggtggaacaagaactatatagagatgaattcattgagacttgtataaaaatggtttcacgagaccattgagtttataacagagcagaactctaaattctgattaatgttcaagcaactgactagaccaccttctaaattcatttactagagtcctgcttacacctctataatcaccttaattaatttttctatatcaggcctctgcttgcattgatattattggtcccttcagtgaataataaaatacttgacgttcctatgctgaatttttagaaccaatatttccttaggaaaatatccggaaacatgactttcctaatttaggatacatgttactgcgtcataacaacaaatgtgttaaaagtatttgttgatgattttctcttaaatataaaggtttctatgatgtatatatacacacatatacatgtatatacatacacatacacacatatacatattagcctttaaaatatattccaattcacttttatttaccaaattagactgctgtaaaacatgattactagaaaatgtaccacacaaaactctgatcactctgatcatacttttgtttttaatttaactttttttgtaatttaatctccatagtttataaagggcattactgcttgtcaggaaaaaatgagcttgtatttctcagctgtgtgtaaattacatgcattttatattttttaggcaaggcctctatcaatcaatattttcagaaaatgacactcctcagttaggcagggattgttactgaagctgataaatgtttactcttcattggagactgacaaatagcatatgacatagactactcttatgctcttacactgcttgtactaaaacttgtctagaaatataaaattcaaaaatgtgattttcatgtaaaactgctttcaaatttcttgttaggaagcttgccagacactccagagtaacattttgtgaagcaagtcagtattacacgcataagtaaatgaagtagagatttaaacaaaaatacaacccaatgttgtaatacaggcaaaatataatatttttaaatgatcaccatgtgaggtctatattcaaatgtcttttcataaatggagtccaggcactctttgtagtttatcaagagcaggtttaacagcagtagtttccacaaagcaggctgaagtcatttaatccatggctgctttttatacgcagctgctttatttgagcttagagaggagtagaccacataaatgtcatgttaatattctaaagtgagttaaattgtgttagcaacaaagcttgtcttatcagacatttcaccttggcctatgagaaaatgtgatagttatggtattaattgatattaatcagtaaggcagatatctttgggaatataatgcatagaaaatagtattttcttcctcttcttcttcctgtatttttttgaatctcttggcttcagtgagaacttcctgttggatttattcttatctttccttaattgtttaattttcttctttccacagttcttaaactgaagaaggcctgacgttggccatagccacttaaacactgttagtctttccatcttgccatgccaaactgaaatacttttacctatccactcatttagtaaatatttactcagtgtctaccattttccaactaccacaaaaggtgctagggcgcaattatgaacaaagaagtcagcagatacttttttcacagagcttacagtacagcaaacgggcaacacgtgtaagcaagtaagttcaatacaggttgaacatccctaataggaaaatttgaaatctgaaatgctacaaaatctgtaattttttgagtaactacacgatcatttttaagggaaatccttattgaatcatttcggatttcagattttcagattatggatgctcaactcgtatgtataataaagatattccaaactgaaaatatccaaaatccaaaacacttctggtcccaagcattttggataagggatactcaacatatattttggggcaagttttattatagggaaagctaacattgcccaatatttagtcttgaggcacaaagtcaaccattaatgtagcacttcagctttggaaacatttcatgttaatgaatattttggctgatttttctatgtatgtatcttctgcctcttttcaaacactgattcatggtagcttggcaagctgaatgattctccaagaggagtattatatgcttcaatgtcttatcttaaccacccccccaatctatctttaacatttccacatttcatatatcatctcagcagatttctacccttgtaagtttttgttaaaaagaaatatgccaaatttaatagagtatcatagatgaagaagtgtatatttgtatacttatgtctcttaaggagctttttatactaagaaattcagaaaactacatgttctggttctttaataattaaatatgtgtgttattcttttgactttcctatcaaagtaaaaacgttgtctcagcagggcattcaacatatcttaaccattcaccatagtactgactatgtaataaacaattttctaaatgtactagcaaaactaaagcatatatagtagcacagcctctgctctatatgaccatggtccaggaggtatacttaagagttggttaaatatttatagctgagttagtcatgtttttggctttgggaaactgcagtgttcagatccccactgttaaaatgtaacgtgggccaggcacaatggttcacattcctaatctcagcattttcggaggctgaggcaggaggatcgcttgaggccaggagtttgagaccaaccggggcaatgaagcaagaccctgtctctacaaaataacaataaaaaattgtttaaatgtacctctgcattgtgttgtacacctgcaattctagttactcaggaggctgagctagaaggatcacttgactcaggagttggaggcctgtggtaagctacgactgtgctagtgcactccagcctgggcaaaagagtaatatcttgtctcttaaaataaataaaatgtaatggtgccataagtaaatgcatagatatgtgatccaatccatgagttttaaaatatgtcaggtaacaccaaagtaggacacaaaaacaatttgaatgtttatgaaaaagagtacttcaacaggaagtagacttagagagccataggacagaagagtgtcttcctaggcaataggaatgacgttgaatcacattttggaaatagtaagatgtttgccctaggaataagcttaaagtagtaagagataagactaaaagaaaggacaggactagaaagcctatgaaaaatattagtaactactgagtttggaatctttaatataggtagtgggagccactaaatattttgaataatgaagttacatgatgaaattagtattttattaagagtgtggaggctatgtattcaatagattcaaatatgaaagagatgggagatacagaaaattttcagccatgagcagaaaaagagtaggaatagagcctaccagtgggaaaattaaaacttgaaatattggatcagaaatctgatttgagaggaggagccaagatggccgaataggaacagctccggtctacagctcccagagtgagcgacgcagaagacgggtgatttctgcatttccatctgaggtaccaggttcatctcactagggagtgccagacagtgggcgcagctcagtgggtgcgtgcaccgtgcgcgacccgaagcagggtgaggcattgcctcactcgggaagtgcaaggggtcagggagttccctttcctagtcaaagaaaggggtgacggacagcacctggaaaatcgggtcacacccacccgaatactgcgtgtttccgacgggcttaaaaaacggcacaccaggagattatatcctgcatctggctcggagggtcctaccccaacggaatctcgctgattgctagcacagcagtctgagatcaaactgcaaggtggcagcaaggctgggggaggggcacccgccattgcctaggcttgattaggtaaacaaagcagctgggaagcttgaactgggtggagcccaccacaactcaaggaggcctgcctgcctctgtaggctccacctctgagggcagggcacagacaaacaaaaagacagcagtaacctctgcagatttaaatatccctgtctgacagctttgaagagagcagtggttctcccagtacgcagctggagatctgagaaggggcagactgcctcctcaagtgggtgcctgacccctgacccccgagcaccctaactgggaggcactccccaaaaggggcatactgacacctcacacggcagggtactccaacagacctgcagctgagggtcctgtctgttagaaggaaaactaacaaacagaaaggacatccacacaaaaaacccatctggacgtcaccatcatcaaagtccaaaagtagataaaaccacaaagatggggaagaaacagagcagaaaaactggaaactctaaaaagcagagcacctctcctcctccaaaggaacacagttcctcactagcaacggaacaaagctggagagaggatgactttgacgagctgagagaagaaggcttcagacgatcaaattactctgagctacgggaggacattcaaaccaaaggcaaagaagttgaaaactttgaaaaacatttagaagaatgtataagtagaataaccattacagagaagtgcttaaaggagctgatggagctgaaaaccaaggctagagaagtacgtgaagaatgcagaagcctcaggagccgatgcgatcaactggaagaaagggtatcagtgatggaagatgaaattaatgaaatgaaccgagaagggaagtttagaggaaaaagaataaaaagaaatgagcaaagcctccaagaaatatgggactatgtgaaaagaccaaatctacgtctgattggtgtacctgaaagtgatggggagaatggaaccaatttggaaaacactctgcaggatattatccaggagaacttccccaatctagcaaggcaggccaacattcagattcaggaaatacagagaatgccacaaagatactcctcgagaagagcaactccaagacacataattgtcagattcaccaaagttgaaatgaaggaaaaagtgttaagggcagccagagagaaaggtcgggttaccctcaaagggaagcccatcacactaacagcggatctctcggcagacaccctacaagccagaagagagtgggggccaatattcaacattcttaaagaaaagaattttcaacccagaatttcacatccaggcaaactaagcttcataagtaaaggagaaataaaatactctacagacaagcaaatgctgagagattttgtcaccaccaggcctgccctaaaagagctcctgaaggaagcgctaaacatggaaaggaacaaccggtaccagccgctgcaaaatcatgccaaaatgtaaagaccattgagactaggaagaaactgcatcaactaacgagcaaaatcaccagctaacatcataatgacaggatcaaattcacacataacaatattaaccttaaatgtaaatgggctaaatgctccaactaaaagacacagactggcaacttggataaagagtcaagacccatcagtgagctgtattcaggaaacccatctcatgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaaggaatcaattcaacaggaagagctaactatcctaaatatatatgcacccaacaaaggagcacccagattcataaagcaagtcctgagtgacctacaaagagacttagactcccacacattaataatgggagactttaacaccccactgtcaacattagacagatcaacgagacagaaagccaacaaggatacccaggaattgaactcagctctgcaccaagtggacctaatagacatctacagaactctccaccccaaatcaacagaatatacattcttttcagcaccacaccacacctattccacaactgaccacatacttggaagtaaagctctcctcagcaaatgtagaagaacagaaattataacaaactatctctcagaccacagtgcaatcaaactagaactcagaattaagaatctcactcaaaaccgctcaactacatggaaactgaacaacctcctcctgaatgactacggggtgcataatgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaagacaagaaataactaaaatcagagcagaactgaaggaaatagagacacaaaaaacccttcaaaaaattaatgaatccaggagctggttttttgaaaggatcaacaaaatagatagactgctagcaagactaataaagaaaaaaagagagaagaatcaaatagatgcaataaaaaatgataaaggggatatcaccactgatcccacagaaatacaaactaccatcagagaatactacaaacacctctacgcaaataaactagaaaatctagaagaaatggataaattcctgcacacatacactctcccaagactaaaccaggaagaagttgaatctctgaatagaccaataacaggatctgaaattgtggcaataatcaatagcttaccaaccaaaaagagtccaggaccagatggattcacagccgaattcgaccagaggtacaaggaggaactggtaccattccttctgaaactattccaatcaatagaaaaagagggaatcctccctaactcattttatgaggccagcatcatcctgatacgaaagcctggcagagacacaaccaaaaaagagaattttagaccaatatccttgatgaacactgatgcaaaaatcctcaataaaatactggcaaaacgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctccatagatgcagaaaaggcctttgacaaaattcaacaacccttcatgctaaaaactctcagtaaattaggtattgacgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagagaaagtcaaattgaccctgtttgcagatgacatgattgtatatctagaaaaccccactgtctcagcctaaaatctccttaagctgatagggaacttcagcaaagtctcaggatacaaaatcaatgtacaaaaatcacaagcattcttatacaccaacaacagacaagcagagagccaaatcatgagtgaactcccattcacaattgcttcaaagagaataaaatacctaggaatccaacttacaagggatgtgaaggacctcttcgaggagaactacaaaccactgctcaatgaaataaaagaggatacaaacaaatggaagaacattccatgctcatgggtaggaagaatcaatatcgtgaaaatggccatactgcccaaggtaatttacagattcaatgtcatccccatcaagctaccaatgcctttcttcacagaattggaaaaaactactttaaagttgatatggaaccaaaaaagagcccgcatcaccaagtcactcctaagccaaaagaacaaagctggaggcatcacactacctgacttcaaactatactacaaggctgcagtaaccaaaacagcatggtactggtaccaaaacagagatatagatcaatggaacagaacagagccctcagaaataacgccgcatatctaccactatctgatctttgacaaacctgagaaaaacaagcaatggggaaaggattccctatttaataaatggtgctaggaaaactggctagccatatgtagaaagctgaaactggatcccttcctcacaccttatacaaaaatcaattcaacatggattaaaaacttaaacgttagacctaaaaccataaaaaccctggaagaaaacctaggcattaccattcaggacataggcatgggcaaggacttcatgtctaaaacaccaaaagcaatggcaacaaaagccagaactgacaaatgggatctcgttaaactaaagagcttctgcacaacaaaagaaactaccatcagagtgaacaggcaacctacaaaatgggagaaaatttttgcaacctactcatctgacaaagggctaatatccagaatctacaatgaactcaaacaaatttacaagaaaaaacaaacaaccccatcaaaaagtgggcgaaggacatgaacagacaattctcaaaagaagacatttatgcagccaaaagacacatgaaaaaatgctcatcatcactgggcatcagagaaatgcaaatcaaaaccacaatgagataccatctcacaccagttagaatggcgatcattaaaaagtcaggaaacaacaggtgctggagaggatgtggagaaataggaacactttttcactgttggtgggactgtaaactagttcaaccattgtggaagtcagtgtggccattcctcagggatctagaactagaaatcgcatttgacccagccatcccgttactgggtatatacccataggactataaatcatgctgctataaagacacatgcacacgtatgtttattgcggcattattcacgatagcaaagacttggaaccaacccaaatgtccaacaatgatagagtggattaagaaaatgtggcacatatacaccatggaatgctatgcggccataaaaaatgatgagttcatgtcctttgtagggacatggatgaaattggaaatcatcattctcagtaaactatcgcaagaacaaaaaaccaaacaccacatattctcactcataggtgggaattgaacaatgagaacacatggacacaggaaggggaacaccacactctggggactgtggtggggtggggggagggggtagggatagcactgggagatttatctaatgctagatgacgagttagtgggtgcagcgcaccagcatggcacatgtatacgtatgtaactaacctgcacaatgtgcacatgtaccctaaagcttaaagtataataataaaagaaaaaaaaacttaaaaatttcagcaaaccaaaatgtttgttaaaataaccattaaccacatatatatccaaatattcattatatataaaaaatttctttaaaatatcatgctcataaatagagtaagttttaattaacaggaaaattgtttcatatgttattatctttaccaaaaaataaaaatcaccaccaccaccaccaacagcaacaacaaaaggggggggacataaaatctatataattttttttttcttgaaaactcagcccaaatggccacctggtgcttcaagacgtgaagtgtgaatacatgtttcacttggaataaaataatatcttttcttatttacatccagatttcaaactccattttaccttgaacacaaagtaatgtgatttagtgtgaggaaagaaaggaaagctttttctatgaaaatgactattttatggtattttctaataattaggtcttataaaacttccccaatgtttttactacaatgctggtagaccacagccagtctgtcttgctccaggatttctgatgatcttattccattaaaaaaaaagactccacaagtcttgaaaactaaactatattagcatgtagttttgggttgatacaaacttctctcagctgcattcccattagataaaactgaatgatgcattggaaacttggaaattaaaaacatgtatctgtggcagaaagataatactgcacacaccatttttctttttgctgcttcactaaatcagttgatgctgaacacgcaataaggtgtataggccaggcccacagctccttttggtcaggtgcaattaggaactaatgttaactgtcttctaatgcgttacatcaatagtacatgaatgagtaataagctctaacttttgcaaaatatgtgaacaaattgatctactactcacaaactcattatccaacaaatttatttttgccctcacaaaaaataaacttataactgacaaaaaaataaaaaagaaatctgatttgatataacaggaattttaggaaaattaaagcattactaggagattcaaaaacggcttcatatagagttgataccatataaattgggtctatagaagcaaaagcctatagacatacaggaagctgtaattaaggtaatgagactagagctcaagtgaaatatgggcaaaactgatgaataaacctgattaagccaaaatcacagagggttaccagtgacttggttagaagtttgaacattttctaggcatccaataatgtggttgcgtaggcacaggaataaaactgagtttggttttggatgatggactttacctaaggtgggtcttgttgcttttaaaatcatcactcccttataaagaaaaaaaaatctatgcagacatcccaaaataacattaagacactgggcttcgacatcagtcctggattcattcaaatccaatctctacttcctattagttatctgtataatatgggtaaattcctttctctcctcaacagtttgcttctacattttaatgtacatgtgaagttcctagcccttaataaagcaattgtaaggcttaaataagaaactccaggtaaagtagctggcacataataagctcatattaaatattagctattttcacaaactgatcaggtttcttttcttggactgccggtgacacagcagaactagtaatgtagattttaaagttaattgaatggaggtaaaactaggagactgaaaacttcttctacatgttcacttgtcacccgtctgcagaacagaattggagaacatccataataacacaaggaaagagttagcagagcagataaggtatacgatatagatgatatggatatacttatagatggaatatcatactaggaagctgtcccaaattcatagaaatgaatctttcaaaaggagaggtgtgaaattcactctgaaattcaattagaatataattagtgactgttgagaatacagttttgatagaataaatgaggcagaagacagcttttaagggattaaggagaaaatggatattaagaaaatgtaacttcaggcatagagaataacttcaggatgttttgcaattataatggttataatggctcaaaacttgccaagtcctgcactaaatgtttcaaatcaactaattcatttaattcttgtaacagtcctatggtatgaatacaattctcactttcattttctagatgaggaaaaggctcagggatcttaagaaatttgcacaagtttacacagctaaaaagtggcaaggttagttttgacccaggcagtccagctccagaacctatgctgtcctccctactgttcacatggcttctgagacaagagtagtgatttaaatttagaacatgtggccaagtcttttaccctaatgtggcaaaatcaggaataaaaaattaagtgttttagtattcattttgggtaaatttctatgagtgcgcttgaaaacagttcatgaaactgagaaaaacacaagtgtaagattaccataatacaaagcatgtgatcactttggaaaggtgtatactactatggaaaaggtataggcaatacttctagttagaatgatttggaaaaggtttgtaggaaagatattttaattaaattccaccagaggaaaagaaataatacagcaattttgggaaattattaacagaccagtggttggagattgagataaatttggaaacttgagaagtatgtggttgaaatgtgaccatggacagtcgaaagtaccactgttgaagtgttttccattgtggaatcttaagagaagagcttttatactttagggcagcagttctcatagtgtggttctcagacatcagaatcaacagcaactgggaatttgtgagaagtgcaaccgctctggctgtactctagacctacaggatgagaaactcagggggtggatcccaacactccctgttttaacaaacctctaggttattctgatgcatgttcaagtttgagaacccttgttttaagggatgtggttgccattaagtctattcaccaaagttccattcttttattccaggctcctgatagtatcttttactctgcctacttgtactttgatatggccatgtgacttacttcatcaaattaaatgtgaacagaagtgatgtgcgccatttccaagcagaagctttacgggttatcgtgtgctttcacatgttctcttgcgttcttaaagtttatattgagatgacccttctctcagcccaggtccttcagctgagtacaatgagttgagacgcctaccaatctatagtgacatgaagtttggcgggaagaaaattctattcttttgagtcgctgagatatcagaattattcttatagatgcataatgtagtgtatcctgatttataggggccatggtacagagaagggatctatttcatggtaaagagaacatgtgtatcaacagatttatggtatctatggaagaggaaaacatgggaatcactattaaacctcagaaaaaaggatcatatattgtcacataaataagagaggagaaagaacagagagaaggagaagttaatgaccaccaacatattaacaatatttatctttcggtgtaagaattttacatgaatatttactatattattatttaagcattatataatcataaaatagaaatgaatattataaaagcataaagtttatgacacaaaattggcctcgaatctcatcttttggagggcataaactcatggaagactttcttaattagaccattttgtgagtgtatttactacctcttgatctgtatccatgtgtaggacactgttttaagtacttcccatgcgttatttctatgatctttctcatagacttgctgggtaaaatttgttatcccaaggttggcattgaattctcaagtgtttacataacatgccctagattatacagtaagtaaatatatactcatggattcaaatcaagttatttatgactctaaaacttaagttcttttcattatagcatgctgttgtatgaagatttatctgagtctgtacctacccagatataggaaggtgtgtgtgtacgtttgtttaaacaagttagtatatttggtaacctttagaaaataagtgactcttgtatgtgccgagaaggaggctggtgatttatgctcaatgtcatagtgtaatagaatctgtaataatcataataacgcaagaaaaatctgatgactggacatagctaatcacacggatattgccactaaatgtacttccattttacaataaagcgatgtgataaagaatcatgactctttgagagggcaacagcgctgacatttctaggtcaaaagttttcatgagattatggagtacctaaacatgtacaattagcctccagatgttcacacatctgcaatatattttttcaaacctttgtcactcactgtcagttaggattcgaaacatactaaagcttttctccccctttttaaacacaaaatcctaaaactttaggagccagacttggcacatatattgttgtcgttaaggtgatatccatgagtccataagacgatcaacaaccttatctgtctgctggattgtacaaacagaattaatagctgccttaagatagagtttggctgaacgagtagtacttctgggcatataaatggacttcagagaagtccatgaattttctggtatcatatgcaaattcttttgtgtttgtacaaatgtgcatgagagggtccaaagcttttgtcatatctctaattggtataataccaacacaatatttggttgcatagtcctgtgaatatactaaaaacattgagttgtatactttaaacagatgattgtatggcatataaattatatctcaataaagctgttccattttaaacatgactagcctagaaccttttaaataaacttgttaggcaaaagttgaagccgcttgatgtttatgttactattagattggtgcaacagtaattgcattttcttgccattgaaagtaatggcaaaaaccgtgattacttttgcaccaacttaatatatttttagaatgtgtgttccatgtcaaatggtccaactcttgactcaatcccaactaatgacctgttcagtgcccttgactatggtgccgtacacttggctatggtcatgccactatgatgacctggttacacagctaccacccattccctttggtaacagataacacaccattctgatattgtcactgcatcttctggcttgtatcactctacagtaatgacacaatccaactaatatgtcttttatttttaggaggaaagaatgatgtgtttattccgttctaaaataaagccaatgtttttattaaatattcttcgtgcccactgggatgtgaatgccaataggataaaatacatcagagaagcctaaggattccatgagaacaaggaatcagacaagtaatcatgtgccacagatagactcagctggtggaagtgaaaatattataggtcaagatgcctcataggtaagaggaaaaatgcgaggtagagaagaccgggagttaatagtgtaagtttaagctgctgggcaaggccgaagcatgaaatattcagaagggatacacagacacccaagctaaagctcatctggacaatcacaagggtttagaggagagtaaatgggacaaaagaatcaggaatgagacctaagcaatgagaaaatgggaagtaaattatgaagatacaaggcaacacagacattgggcagtaggtataaggaaaaaggctggggccaagaatcaaggctttggcctgcttcccatatgtgtgatatttgacaagtaagtaatcttttcgaaattttcatgttctcttctgtaaaattgttacatgaataatttatttaatcctcactgcaatcctacgatgtagatactattatgatccccattttacagatgaagaaacgaaggccaagagaggataagtaagttgccagagatcacactgctagtaaatggcaaaatggagattcaaaccccattaggctggtgctgatgataccctgtctcttcctctgagtccttcgcatttcagtggacattgttccaacttccacctgccagctcctgcatctctttgcctactggagtctgttcttccggagtgcatgcaatagatcaaaaatgctagggagtgaatgcacagcccctcccgggatctgccaacagatgaccagcaggagttggtgtataaataccttagcattctcatctcttcaaaggataagtctgaggtgtgtgttccacataattttcttcaagtccccagtcaaattgagcgccagttgtccaccacagtttaaactcttgaaatgtagtcttcattgactttccttccttctttgtctcactttatcattttcctactcatattccctagcatctcatcccaaataaactagaagggggaagtattctgaaaatcataaagacagggtaaatttaaactattattttattatcattattagtaacatcgatatctgagccaaaatcaaaaaagaaaggacccttatttgtactctttctggttaggattctaaccatgagtgttagaatgttgttggcactgaacccatagttacagtttccaataatttctgaatgccaagaaaagtgaccgtggaaggaaagcagagtttttaactctgtggaatgtgttcagtgggtgaggaatgggaggaagttctattttgctctcagtagaacattaaaaatggcttcctctgtaaagcattctgtggttcccccaagataagggcaggtctgtctgtcataaactgccatagcacccattacttatacaactaaataaaatagtattgagtgatgggtggttagtctctccaatgtagctctttttcaatgaaaatagacattgtgtttcttccagggcctcacacagttccctatatattttacataaaaaaatatatacctaaaatatttggtgcctaataaatatatagaaactatgctaggcacagggcagggtgtggtgatttagctagactatttaccctgtcctcataaacacacaaaatggatttaaggaacacatattcatctttaaaccctctctcaccagctagtaagcacactcagggcttttcagttaccctctacttacaagctatttctgaatcatttctgcaaccatcttctaggaaggataaccattcttacaattttttttttttttgccattcctccaaagttgctcttttgaatattatcaaaacttccaatttgccaaatctaataaactattttaacccacatcttacttaatgttttcagtggaatttagtacttaattattcctctcatgatcaaccctcccacctctctgccacaacctttttggtcttcctagcattgtgtgatcttggtgtcttcttctcataaggcatattctctcatggtttcaactgttaaatatgctaatgattaaaaactgtgcacctatctgctcaaacctcctttttaaggttcagattcatatacatggtggcctagtagacattttaccaaaagcacattaaattagacctaagaaaaatgaaatccatcttctttactccctccctccaaacctcgttatttaaactggacttctgttcacttgtgtaagacattatcatacagatcatcctagcatacttcacctccctatcctgtcatatctagtcattccttaagtcccatcaatgaatcttctccatcccaatcaatcctcttcatctgctttgtcaatactctaggttcaggatataaacacttttcatctggactattaccagtctccgaaaagatacaatttttctcaaatacgtatgattttagaagagattaccatcaggatcattggctcattatcttcagggcagtgatgcggggtgggagagttcttaaaggactgtattctacatgtgattatgagtcaaattttccagaccactgtagacacaatcttacacttcactgtttcacgcagctatgatacctacacaacaactgtaaggatgtgagtttgagatgtagattgttattgcagactaacaaccactccttgctaagtttgtttcaaaatggacttaagggggtgatctcagttgtttttggcaagaaaaaagtaattggcaagaaaaaagtaattggcaagaaagccagagaaagagaaagaggaaatgtttgttcagcccatgaatgagtaacattacaatgctttttataacttcaaacattcacccccatacaaatgctctataaaactattgtcatgatgatcaatcagcattttaagttgaaacatatatatccaagtttctgatcttgttctgtatcaacacagcactcacagaactcaggaaatccctatagcctccttagcttccatctttctcttgtcttttgaaataccttaaagcacaaaagcatattttcaggcaaaggtaaaaataattgtaggaatgatggtttcacagacagggtgtcttcagtgacagttaagttcctatggtgagacactgtaatgagttcaaagtgtttacagcttcaatactgcttgtcaaacactccttcaatgcaatgaattcttggctacaagccacaaatgtgctttgagaaataaaaagcgagtgaatatactggtgtttctattattggtccagctgagatagttgcttttttattcttaataaaagttttctcgaggtagtcataatttcaaaaccctgcttatagtaatgaatcatggttatttacaaagtaattcagtttcactatgatcacgatttgtataagtaatgtagtcatatagtcgaagacttttcagggatgttttctgtttaaactgataagctgcaaaattctgtattttccttaataaaaatgtttcaggaaaaagacagcgaacagctagatttgaagagtaaaaataaagaataaagccagtaggaaacacaaacttctagaacttttaaattgttaaacatctttgtggaagtaactaccattttcaccaaatctgcaaatcatattccaacaagttgtaaaaataagccataattcttagaattgaaagtctcttatcattctacaggtaataacatgacttggtcctgttctctgggtaatggagtaaaatgttactggcatattcccatgtttagacagatttgcaaatagccccagagaattccattcctaacctgggatatgttactcaaagacgttctatctggagtcaagctttcatacaagaatcatagacatacttcaagggatccatgaacactggaaagtatatggaaactatgttcacgttttttatttttcaagaaaatctacaccatccagcagaatctcacacagatccttaattttaaaatgagttaagaagcagtggtctagggcaggctatggttctcaaagtgtggatccagaccagcatcagcgtcacctgggacctttttagaaataccgaatttcaggactctcccagacttacttggttagtatctcagggagtgagacccagaaatctgtgttttctttttaatgtttaatcgacacataattatgcatatttaggaggtacagagtgatattttcctatatgaatataacatgtaataatcaaatcaggctaattatcatatccattacctcaaatatttgtcatttctttgtgttgggaagtttcaaaatcctctcttctagctatttaaacatgcacaataaattactgttaactgaagttaccttacagtgctttagaacactagtacatatccgtcctatttagcttatcattttgtatctgttaactagcttgtccctttcctccctctcctccctcttaccctccccggcttctgctaaccactattctactgcctgcttctatgaaatcaaactttttagctctaacatatgaaaacttgtgatatttatctcttcgtgcccgacttatttcacttaacagtatccaggctcatccatgttaccaccaattacaggatttcattctttttatggctgaataatattccattgtgtttatatgccatatttttaaattcatttatctgttaatggacacttaggttgattccgtatctcaacaatctgttttaacaaggcctccagaaaattctgatgtgcactcaagtttgagaacctctaatttgcgcaacaattttcaaatggattttttacaatgtctcctcaaattttgattcagttatgtttgggaaatatattttaaatcttcccaggcaattctgaggattaacctgtttgggacagctactccagggcaaagctactcaaactttagttggagaacgagtaccatcagcctcacctgggagacagttgtggctgcagaatcttgcccacatccttagacatactcaatcaagcgtgagagtgagacctagggatctgtgttttgctgggtttatttatttacttacttactgtatttgaaacaagatctcactctgttgtccaggctcgagtgcagtggcatgatcatgcactcactgtagcatcaaactcctgtgtttaagcaatcctgatcctcccgcctcagcgtcccgaatagttaggactacaggtttgcactaccacacctcgctaattttttttttaagtattttttgctgtgtttctcagtcttgtctggaactcctgggctgaagggatctgcctgccttggcctcccaaagtgctgggactacaggtgtgagccaacatgccggggaggaatccgttttaaccaccaccttccctgatgactctgatgcaggccacactttgagagcaaagcacagccacagaaaaaattagaaaagttgactattcatgtgacacaaaggcatatagctatgccttctatatgtaggctttgaataacttttaataatagtaaaaaagccaggatagcttttaataatggtagaagctactctttatttggtacttactatatgacaagcacaatggtaatacacgtatttcccttttatccttaaagaaaaagtgtaggccaggtgtggtggcttacacctgtaatcccagcactttgggaggctgaggcaggcagatcacctgaggacagaagtacgagaccagcctggccaacatggcaaaaccccgtttctactaaaaatacacgaattagccaggtgtggttgcggatgcctgtagtcccagctactcggggaggctgaggcaggagaattgcttgaacccgggaggcagcggtagcagtgagccaagatcatgccactgcactctccagactgggtgacagaacaagactccgtctcaaaaaaaaaaaaaagaaaagaaaagaaaagaaaaagaaaaaaggaaaactgcgagggtggggcatttaatcctgttatacagataagaaaactgaggagcaaaaagtttaattttcattaagtaccatagccagctggggtatgagtccagtttgaaagtttgtgattttaataattacatctacagaacttcagaaaatatattttgaaatgagtcttagggctaggtaaacccatgcattacatgtattattaaagggaaattaagaatgatatctcaaaccataaatgatggtattaggtaagtcagtaagtatatcaacatgcaaattaaaacagattatcaatacatagggattgactaagtataatatggcaaccaaattatcccagaattgccctctcaaagtaacaagagcttatacatgtgaacaaattttacacattctgtgatgtaaaaagactgtgtcatcagtcattgcagagaaccaggcagcaagtcacttccttacaattgttcacagctctctgattagctactttgcctgaagcataaaacataagcacattcttcctcacctctatgggtactaactggactgtttaatgtgatggagtaattaacagaaccttttctcccattggggacctacgtggcaagtgccccattaggtcctaggtacatacagaacccaaaaaatagaagccaatgtggggaggaaatggaactcattattttatatgctatggcacgatttcccccctaccaaatttactagactgattagtaaatgtaagccaaaatctaaggtgtgattgaatcactataatatccatcccttgagaactgtgactcagcagataggaaaagagaaaactaatgtccaacatcttgtcactgacacttgtgaaattatcatttgacaaaccatgaaataatttggcaggaatccaatacaacaaatgagtcatttcattaaatacaattctgtctccccagctaaatggtatgcaatgataagatcaccattttaatagttatctagaaatagatgcctaaaattctttcctttatgactttttaacagccaacctgagtacaataatgatattatccagaatttatatggtcaacattcaattgctcacaaggttattaaacagtttataaattatcctgttttcttcccctgctctctgctcctaagaattacatttcttattagaattttcctaaggaaatggaaagaatgaatggaaatgaagtggaaatgttcaatatttcaagttcttaacacgtttggacattatttgaggatcctggctaaagccaagatttgctgaaggcttttagggttcccagttgctataatctctttaagactctgataattgaggtagacaccaaggcagaactacgtaaaattatcatgtctgtaaacaacaaaaaaatgacacacaattaaaagccaaaaaactcattattgaatcaatagtgagaatttatgtggctaacaccacacatagcaaaaaagatttgatgttaggtattaggaattgcagctgttatatgaaccaatgaatcacaatttgttcatattaagacataggtagttatatacagttcactgatcttttttgaaatgtgattgtgagccatttccattggatgaaaaaacagacgccttgccttatttgtcacttttacccatgaaacctagtacatttctacatatatagaagacactcataagtgtttattgacttgtgatttacaacattaagaataaacagagatttttccctaacggaaaatcatgtatattgctacatttatgttaatcataaactctatgaaaactagcatagcattagagttagaaaactgaatcatgtctatcattttcaaactctatccatccttgagaaagctagtttcttcagattaaaatataaatacatttaaaaattctgacaaaagggagaaaaacttcccgtgtttcatatgaagttaggcgaaatttgatttacatttggaaagaagagaaatccacttattttagaagtaaatcaagaaatgtgcaaaatatctatcaggtatgaatttaaaatatgatattcattcaataatttataacagattgctataaatcagatacctgtattgtatttcttccctgtgtcaggttttggaaaccacagagaagtgcatatgacagtgacaggaagcagagccaaactcctaggcagataggggtgggtacccagtgaaaccccacttccaagctgaagacagttaaaggcctgaaagccaaactacaaatcaaatccttgcagtggattgagaacttgtcctcctatttggtgtgctttcctctgattgatctccacccttcacctattttacttatacctactgatatggtttggctgtgccctcacccaaatatcatcatgaattcccacatgttgtaggaaggacccagtgggaggtaactggatcatggggtcaggtatttcccgtgctgttctcatgatagtgaataagtttcacaaaatctgatggctttgtaagggggagtttccccacacaagctctctgtctgctgccatccatgtaagacgtgacttgctcttccttgccttccagcatgattgtgaagcttccctagctacgtggaactctaagtccattaaactctttttcctgtataaattatccattctctggcatgactttatcagcagtataaaaacaaattaatacagtgaattggtaccagtagagtggggtgctgctgaaaagacacgtgaaaatgtggaagcaactttggaactgggtaacaggcagaggttgcaacagtttgagagctcagaagacaggaaaatgtgggaaagtttgggacttcctagagacttgaatagctttgaccaagatgctgataatgatgtagagaatgaaatccaagctgagatggtctcagatagagatgagcaacttgttgggagcccgaacaaaagtgactcattatattttagcaaagagactgggagcattttgctcctgccctagagttatagggaactttgagcttgagaggggtgatttagcgttatctggtgggagaaacttctaagcagcaaagcattcgtgaggtgacttgggtcctgttaaggcattcagttttaaaagggaaacagagcataaaagtttggaaaaattacagcctgacaatgtgataaaaaagaaaatcacactttctgagaagaaattcacgcccactgcagaaatttgtataagtaacaaggaactgaatgttaatcaccaagacaatgagaaaaatgtctccagggcacgtcagagacctttgtggcagcccctcccatcacatgtctggagtttaggaggaaaaaatggttttgtgggctaggcccagggtccctctgtggtgtgcagcctagagacttggtgccctgtgtcccagccactccagctgtgactaaaaggggccgaggtacagcttgggctgttacttcagagggcggaagcccaagccttggcagcttccacgtcgtgttgagcccgcaggtgcacagaagtcaagaactgcggtttgggaacctctgcctagatttcagaggatgtatggaaaaacctggatgcccaggtagaagtttgctgtaggggcagggccctcatggagaacctctgctagggcagtgcaaaagaaaaatgtggggttagagccctcacacagagaccctactagagcactgtctattagagccatgaaaagagggccactgtcctccagaccccagaatggtagatccactggcagcttgcaacacacaccgaggaaagccacaatcaatgccagctcatgaaagcatccaggagggaggctgtaccctgaaaagccgcaggggcagagtggcccaagaccacgtgaacccctctcttgcatcagcatgacctggatgtgagatacgcagtcaaaggagatcattttggagctttaagatttgacagccctgctggatttcagacttgcatgtgccctgaagcccctttgttttggacaatttctcctatttggaagggctatatttacccaatgcctgtaaccccactgtatctaggaagtaactaatctgcttttgattttataggctcacaggcagaaggaaattgccttatctaggatgacactttggactgtggagttttgagttaatgagggaatgagtaaagactttggtgcactgttgggaaggcaagattggttttcaaatgtgaggatatgagatttgggaggggccgggggtggaatgatatggtttggctgagtccccacccaaatctcatcttgaattcccacatgttgtcagaggatccctgtgggaggtaattgaatcatggggacaggtctttcccatgctgttcttgtggtagtgaaagtctcacgagatctgatggctttgtaagtggagtttccctgcacaagctttctttgccctctgtcattcctgtaaaatgtgacttactcctccttgccttccaccatgattgtgaggcttccccatccacatagaattgcaagtctattaaaccctttttgctgtataaattacccaatctcaggtatctctttatcagcagcatgaaaacggactaatacacaagcactgacttctccctgcttagaacacctttccatccccacctgtattttcctccctcatgcctttaccctcttccttctccacaacaagctagtacccagacttccatctaaatatcacttccttcaaaaagacttcatttcttattcctccagatacagattccctgatttactatttttatagcactctgaattttaaatagtacacatcaaaaataaaattaaactattatacaatcataattatgctggtattcctcaaaagacaatatattccaagacatgagccttttcttatgtcttcaataaattcattcaggcctaacagaacactttgcccataggaggtgcttaatgaacatttatggaatttatagttcttccagatgtggttcgactttgcattgagtctaccttagaaatttgtttttcatactcataaagatttcctatttgaccaccacaaaccctctgcactgccactcatagtaagccacacagggagtatactccaaccaagcttcagtacaaattcttccctcagctgtgggtgttctataacatttaattggctttcttaaaatctgacacaaataactaaagactcttgatgctttgtcagagcaaaggagtgtgaaaccattatctcctctaaatactacattatactatactttgtatcatatttctgttaatttagcatttttagaatatttataatacaatgttagttctccctttctgtacttgcgtctacatgttaatatgttcttgagggaaggaaccgagccttattcacctttatataacctagcaagttgaccacatggttggtgttacataacaagccattgaaaataaagcaagcaagcaattaagaaggtaccaaaccctgctcaattctattttgtgggttttgaccccgtgatttagcctatcatgaaaaattctcatcttcattttgaccccccacccagatttgtgccatctgcaaaattgaaaattacccctttgctgatgttatgtaaggtattgatcaattattcagcagcacagaacctgtggtagcttactaattataataaaacaatatttagagttgctggtcacttaatatctaccaagcacctttttaaatacttttacatgtatgtaactacatacatacatgttaaacttaaatattttcaaaacaatcttatcagatggatacaattatcgccattttacagatgaggaaactgaaacacagtatgactaactttctgagggccacacagcttttaagtaatacagctaggattcaaacccaagcagtgcatctcaagatctcagacttttaccactctgccctcctgactaaaatgtgtattctatatacagagctcactctcccaagtcaatatggttattaattcctctgccaactctgtcatatagatcacttatcaccatcttatcccgataccatagaaccttagccactgttttactcaaatagaaataaaccattaaaaaaaaaaaataggtgccacagtaaaagtatgatctcttcaacctgatgagaccatcacaaccagtctcaaaacttcttttctgaagaacaagctattaatttagatgaatgagtcaataacaaacttatcgcagatttaaacatacagaaattttcacggcaaatctgtaaaatatgaggtcaataaatatctaatttatactcaatagcatttatactgttatagaaatgatgcaatatacaagacacataactgtacataacaccctagccattaaatcattgtgcagatggctcccactatcattgtgacttctgtgcctctttccccatagtgtttgccaagccataagctgatattttattttaccttcagttctctgtacattacagcttctctgcctgcaacatccttttcatctggctcctttacatgtcaggtaagttaccactgccccttcaaagcctttccttacggcctgagttttggttcaatgcatgacctgactgtaaaacactatttcccacatcatgtatgtctttccctactcatcacattgctgaagaattgcccatgtatctgcttgtctcccatgataaggacaatgtctttttcctttataacataatgaggagagctcaataatgaaagctcaactttttttttgtatgggtgaatgagtagttctaagtaaatacagtaaatttacttacagtatcaatttcaaagaaattctctcctctaaaaatattgtcttcagacaaggaaaaaaaacacaaaaaacggaacatgactaaaatcttaaaggaagatacggaagtgagcacacaatccttctgaagttaaaatatttctataaattcatatagctgtattctaaatctttttggtaagaatccctgaaatgtattctgaattctaatagatgaaaagttccctgtgggcaggtaatgtgtttactccaactaagagcagcccaacacaggaatatttgctctttgaggagtaatacatgttttataactcaatgatgttttcatattcttgagttcttaattacaaatattttcaaacaatattcaattatttgcttgccaggtataaaatataagttaaatagcaataaaaatatcaatggtttgaatttaataacatgttttttccttagcactatattttctaaatagtattagctacttaattaaacttttcctcaattgggaagtgatcaagaaaatggttgtgtatcaaaaggcagagtaagtgaaaacaagttggttacaggaggaagcagggtatgggtttcgcttgtgctatattaactgctccactggagcaaactaattaatttttcttcattgcactgtaatcagcaagcttaatctagggcaaagaagaatacaattgtgattgcaaatattaaggtcttactacctgtcattcagttgcagtaactacagaaagtctattcaataattaatgtgctatggctattggctttgttttgttattgaatacatttattttaagcagcattaagcgcataaattaaatcttagtaacattttcatataagtaactatcattaaaatgcatttgttccacagaagaaagaattatctcaccattccggctcaacaagaaattcagtcctgaacagacaaaaaagtttaaaaatattttataaacattaacctggacttttcgtagaagaaataaagctgagaacgtcatatttcagcagcttcaatacttgttttctgattgaatcataaatttcattactttatacttgcttctacaatgacaaagtacccaaagctaaatgtgaatgtctagtaggtcagaaaaatgtgtagtcgaatatggtttttgatgacaataaaatcgctaaaaaccaaaagcattcagagagtgtaagagaacaaacacatctcttcaaatatttaaataaccctatgggcaacttgatatgatgtcaatattatatgtcttacgcatctagtttataaaagtcatcaggaaaaaaatacaagattaatctccttgtggatcaatttgggaaacaaatgaataaaaccacagatctacacatagatagagggacattccaaggacaatcactacttcagcctttaatcttctggataactggtgaaagccttggcaggaagcactccaagctacttattaaaaaggtaagaggatgttcttatggatacaatcaagtatatatcaaaccatatgctgtcacttgccccatctacattttcccaactttacagttagaattaagtgatgcaaaacagcttaagagaggatctgatggaaagcaaagtgccctatatccctccacagctcatcactggtttgaagtcaggccataagttcatggtgacatgaaattctcttcaagaccaaattagtcttcgtcagcaagaaattccctacaattcagggtttaactcttaaagagattagctccattttttttctaatttcgaatttacttaacatgacaaattttatatatttatagtatacaatatatcttgataggcatatacatttaaaaatggctcaatcaagccaattgatatatccattacctcacatgcttgtgagaacatttaaagtctattctttttgaaattttcaagcatacaatacattgctattaactatagtcttgttatatacacccaacagttctcttgaatttccctctccaacctaactgaaattttgtgtaaccccattcttaacaagttatatgattcagggatataatagaaaatgttgagacatacacattctatctagttttagcccaactttcaaggctctccagaatttcctctactttgactttataatttttctttcgattctgatatggtttggttgtttcttcccccaaatcttgaattgtagctcccgtaattcccaccatgtcatgggagggacctggtaggaggtaactgaatcatggcggcaggtctttcccatgctgttctcgtgatagtgaatacgtctcacgagatctgatggttttatacaagaaagtttcccggaacatgctttctcttcttgcctgtctccatggaagatgtgactttgctgctcatttgccctccaccatgattgtgaggcctccccagccatgtagaactatgagtcaattaaacctttcctttataaattacctagtctttggtacgcctttattagcagcatgagaacagactaatacagattcctttataggtttattttgaacagtagatgcctctttgtattttgcactgtatcccatcaacccatctctcatttttgctgcagttcctgtttctgctgttagagggttaacaccctttcacttcctagctctagcaacaggaggaggaggaggaagaggagggaggaaaataaattgtccttcaaagggacatttctgaggacagttctataaggttctataatgtcccaggcaaggttgaggtacagttacctattatggtcatcagttcaacaatgttatctttattagcttttccttcttccttgtctcacttttccaggtcccacatgttcctgagttttcttactagtttctttgataatcagccaatcatggctttctgtcaggctttgctttgggggaaaactcaaactgacactcttgactattgctgtcacttaaactgaactcttagagagcagtggtgatacattttaattctttagctttaggggccagagagggaagatgatgcagacttctcaagctcacgcagctctagatggcagagactgcatttaaatccaggtctttctcctccctgcgtgttgctacatgccattttggtacctctctacaggcttgccttccataacctttcaaagttcagcattctcctactcatccaaatgaacacagtagtcatgttttattccatccacttgataaaataatgggtcacagcacagcacttgatccattgttattcaacgaccaagactcttgagttcctgtaattatgtaacaagccccttaactgtcagtggtcataaaggcaagaatctcagacttcggaatcaaaccccccatttactcttactgcaatttgccctcacacaggtattctcaagattacgagataacaaagtgtaagagcttagcacagtgcctgaaacacaggatgtgttcaataaagggtggctattattttcacctggagcaaaacgaccacaaataggggccatgtgctccgcagcatcccctgcctgtctcccaaagccagaacaatgagaccaaataggcgtccacaaacaaaacagacatgtaaaatgaaaaaaataaaaaagataaaatgccctcttttacttcatctgtatgtttttcctatgcccatccctcttctctatttcgaaacatgctctcacattgttttgcaactgggaatactcattttatcttatccaattctaactatctttaagtttcagctcaacttctacttctggatgtttcctattttccatcacagcccttgttgatttctctcatatatttctacagcattcatacactataaagtgaaatttactacttcacaaataattttacttcagacctattgaactattttggtcagtcctgactctcaagttacactgaaagttgctagaaggaaaggatcatttctaatttttctctggggtcctctggcacaatactaaacttatcaggcactgaatgcttaatcctgtagacaaaatgtggaagtaacaaagacaggactcaagaaaaacctaatttactcttctctttctcattcccccttagatgcatttctatattcaatgttcattctgatttccaggtagcactttccccactttctttcctagcttaatcctttcactgctcagcaatatgcggcacacctggcaacatgggagagatgagttagttactgcaaaattgtttgcttgttctcttaatgccttacctcaatttctctatggcaataaggctatcatatccaaacagaagaactaagctaaatggattcatcatttcacaaagtgattctttagcaattttcttattattttatatatttttggtttcatatataatgctacctcagaaattcagatatgcaaagtttaaaactccttttttaaagtttcagagagctacaactacagacgagataagctttagcttgatgaatttcatactgactactggatcttatgtttaaggcagatgcaggtttttcttggggggggggggggggcgggggaagacccaggcaggcccatgtgatacatttcttcaggattctaacaattttccactcagaaagtagtccctcaggaaattattaactgtaaaataagatagaggataaaaaaagaattctgaagcagaaaaatacatggaatcagaagcaaagatgctgaataaatctgcattgaaaaatggaaagttcctattttgtgtttatattatacttttgactcttgtaattattcttcttaaatgtcacaaaaatccccccaactattactattccactgctatgtatgtggagatgtacatacccaattattaggtaacgtacccaaggatcaattagataataaaagaaacattactgtaacacaggacttctttttacactaccttctattaaaaagaggagacataagtatgtgaaatggaatcagtatgccacatagtatttaacagcattattcaattgtcatatttgttagtacctcatgataaatgttaggcagaaagccttctctatctctcttcaccttccagggcaaatatctgccctactttgttgccacagagaataaattttccatgactgcaagctctattgaaaatagaagagaaatggaaaggtccagaatttaaaggaactgtatctctctcccattctactgtatgtcccttgagattagagacatttgtttccccagtgccaatcagagacatgatacatagtgttcaataaatgcttggtgaatgaattggtgaaaataacttatgaattatggttgcaggagggaagaacagagtgatataatgttaaacatattcaggtttacttgcaaggaatgggaaactgaatacttcatatattgatgttgcatataggcatcattatgatcatttggaaattagtcaaaatgtctttaatgcataccttttgatctagctatcctgggttcctagcatgatacctcatatataaatgcacactcgatagctttttgtacctcacataatgacatgattttctataccttgaatatgccttcctcttatttcttcttcattggtgcttttgccttgctatttcacctggaatgctattcttccctatttctacctatcaaggcctttctctaaaatatagcccaaatgtactctccgggcattatttctctctctctctcaagtgattgcaatgcctttttatttgaactctttggactacacttaaatgttatcaactcatgtccaagatgtttacaagtgtcatttgttcctgtgactttaataatgttgtctcctttttttgcagcgtctatttaattttatctcttaccataaacccacctggcctatccagggatttcttcaagaagcacagctactgtatggcacattctacactaaatccccagtatataatctgctcatttagtgataaatcggtgatgctcttcacaggagactgaagagagacactcagaagtcttagaattgtgtgcttctagaatacaaagaatttccacaatcatagagtctgaggacttttaatcattactattttcacagcttttggagtagacagactcagtccccagaaaaatggccaatgtaacttatacacacacatacacaatgatgatgatgattatctttaaatgtgacaggtccacccagtagatttccatgtggaatcaaagtcagatgccataaatgactggagtggcagagtctgtcagtggagttacataaactgtgtgtatggcgagtgcagctccagactgaacagtaatgtgcccgctttgagggaggagagtagcactcctcagtactaccaggatggtgccattgcagaatgttgccccagagctgctagatctgctaacagaaacccaaatctgtagtaaggtgtagatcaaacaaaacatatctctgggttccttccagactttccattaacagtttataacgtcttctgaactatctgttcacatacttaaacctgagtcctcgggctgggcatggtggctcatgcttgttatcccagcactttgggaggccgagatgggcagatcacaaggtaaggagatcgagaccattctggctaacacagtgaaacccagtctctactaaaaacacaaaaaattagccaggcatagttgcacgcgcctgtaatcccagctactcgggaggctgagacaggaggaatcatttgaacctaggaggcagaggttgcagtgaggccagatcgtaccactgcactccagtctaggtgacagagcaagactctgtctcaaaaaaagaaaaaaaaagaaaaaaaaaatcaaaaaaaacaaaaaaaccctgagtcctgactagctctcctgcaggagagtgttactgagttaagcaatcaggagaaatgaaactctatcaaccgatggtcacctattaacaaataagatggcatacttctgtactattgctattcatttatttatccattccacaaacatttttcacctaccatctcttcggcattctcctagctactggctatacagtactgaagccaacggacaaagtccttgacaccaaacattctagtaggggaagcagagaagaaataagctagataatcaaacaaggtaatttcagataatgatgatgattttaaagcaagaagtgtgaataggatacaggaatggctgggagggctcatcaggagagctcttttacatatggtagactgcaaaggattcttctgaagatgagacctttcggctcagactgaatggcaggaagttgtcagctatataaagagggagaagaagtatgttcttgcttgaccggagcctggtgaagtaagggaaccagtgtgaagtgagatcaagaagcaagcaggggacagatcacacagggtcttgctggctgctttcagactccagacatttttctaagtacaatgtagagtcttcagaaggtgttaaatagggaacacatgacctaattaatgtagtaaaaagataactttgtataatgcgaagaactgagagactgcttaggaagttactgcaatattaggaggctatggaatatgatggagtgtcagtggtgcttcctttgaataaaagcagcttttatttttcaattaaaatgtaacataattggtttcagtaaaaatgtctcagttgaccttatttctcctgcattaatggggtcatttatatgatatgtcaggagtgctaccgctgtacacaatgaacagcttttttcaattaaaacgtagcttaattgacttgaaccagaaatgactcttgacatctttgtattaataggaccatttctataatgatcatgctaattaatcttcttcattcaaaagtattgtttattcagaattatttaatacaatcgttatacttttaaatcattttaatgttattaaatattatctcaggatcttgaagtctattggattgttatgctgatttaaagagtgcaaaaatatttatagttatgttttagtttaaagcagtgattaaatataatttgcctgtgaccctgtaggccaaaataatgtatcacgataaactgtagatagtgtcagagatgaaaacagtgtttgtctgctttagtgtattcatatgtgaggatgaattttggcacttgtcagcctatgagaaattactactagactaatacttgtcagtacagtaacaactcatcatgctctaaacaccactaagggagaaaagtgatgaataacatacaaagtaaaaattttcacaatcacattaatgactctagttcaaagcacagtaatggtctaccaaccttattgtccaatctatatttcaagtgtctaccttgatatctttcagaatcaattttacgtcaaattccaattaacatagaaaaaaagcagtagcgataaaaacatgtctctattgacttttccaaaagcaatcgtgctctccaaaccccagcctcatttactattactgaagcaaaacgaaatactaagagtactgtgtgcaaataaaaaacgtttgttgattatctgttaaaaaagaccccaaattaaaaacagcctaaataatgagtattacccgcacacaacaacagtatgctatggatttataaaattatcattcttcctaaactgataacgaaaatctttaaaatgaataaaatgttactaatatatttcacagtatgcactgaatggactacataattccatttgggtttaagttgaggttttttttttttccaactaaatggttaaaaattatgtttagagaacaatctggaaaatatatactcacagacaataggcatacaattgacaattgagcacaactacattaaatttacactataaaactcaatcatccaacacttatgaatccaaacattttctaaaactttacaagaaagcttataggtttttatcatggtaaaatatatataacataaaacatataattctaatcatttataagcatacaatttatcagcattaagtatatttaccttgttgtgtcaccatccccaccatccacctccaaaaattatcttcccccaaaaaacttcatatccattaaataactccccataccttctctcccccagcttctagaggccaccattctactttatctatgcattttactgctctagatagctcatacaaatagaatcatatgttatccttttgtatctggctttttccccttagcatatcatcatcaagattcatccatgctataatgtgtgtcagaactttcttaaggctgaataatattctactgtatacatttaccacattttgtttatccattcatcttcagatggacatttgagttgctccatcttttgctactatgaataatgctgctataaacatgggtgtacaaatatattttgaaggtccttttttcaattcttttgagtatattcccagaagtggaattgctggatcacatggtaattctacgttctatattttgagaaaccaacatatttgtttccacagtgactgcaaggttttacattccctccagcagttcacaagtgttcaaatttttccacatcctcaaccatatttattttctgggtttttttttttttttttggtgttttaaaataatcatcatcctaatgggtgtgaagtgctatctcatttgggatttatctgcatttccctaatgatcagcgatatcgattatctactcatggtcttactggccaaactttagagaaatttctgatcaactcatttattcatttttttaattgctgtttttctgttgttgaattctacgatgatataatttaactgtgtccccactcaaatctcatgttgaattgtaatccccaatgttggagttggtgtctggtgggaggtgattggatcactggggcaaatttctgatgaatggtttagtactgtccgcttggtactattctcgtgatagagagttcttatgaaatctggtcgtttaaaagtgtatgacatctccctccacccctcttgctcctgttctgaccatatgacctgccaggtcacccttccctttctgctttatgtttcctgaggcctccccagaagccgagcagatgccagcatcatgcttcctgtacagcctacagaaatgtgagccaattaaacctcttttctttataatttacccagtttcagatatttctttagagcaatgcaagaatggactaacatataggagttcttggcacagtctggatattaattccctattgaatatatgattcgcaaacatcttctcccattccgtaagttgccttttcactctgatggtgttcattcatgcacagaagtttttaatgttgatgcatttcaatttacctaatttttctgttgtagcctgagcttttagtgtcatatccaagatatttaattgcccaatctaatgtttatgttttcttccaaatgtctacgctttcttctaaaagttctgtacttttggccacgtttacttcctgatccattttgacttaatttttgtgtattttataagagtccaacttcatttattttaaatgtatatattcagtttcttagcaacatttgtggcttcattaaaaaatcattaaaaaaccttggcaaccttatggaaaattgtttgacaatatatagtagagtttacttcagggctattatattctattgttctacattccctttttttaagccaataccacagtgttttgattatggtagctttgtagtaagttttgaaatcaggacgtatgacccttcaacttcattcttttttcaagatcgtttcaactattcctggatccatgagattacatgggaatttttgatagagttgtctatttctgcagaaaaactaattgggattttcttagagatggcactgaatgtgtagtttgttttgagtaactcggatacctcaacaacaatattgagtgttccatttcataaacctggggttccttttcatttatttataaaaataaatgtttaatttctttcaggattgttttgtagttgtcagtgtataagtcttccaccttcttggttaattcctaagtattttactctttttgttactattttaaataaaattgtttccttaatctcctttttggactgcatcactgttagtgcataaaatataacttatttctgtatattgattttatttactgcaattgtgcttaatttattagttctagcaggttttttgtgtggaaatctctagaattttctacatataagatcatatcatctgagaagcttataaaatttttgcatacactctttcaaagctgatttttctgatgaaaatttgaaatgcattgcacagcatgaatatagttaatagagtattgctcatttcgaagctgctaagagagtacacttcaaatgttctctccacaaaagtctttgaggtgatagatatgttaactagcttgatttaattactccacattgtattcataaattctaccatcactttgtatgccatatatttatacaattatatattgtcaatttacaataaaaagaggcatataaaatttgcattctcttaaagtctttaatgcttgccaacaccatttctctgattcaattcaagctgtccaatgccgcattaatacataccattaaacaaaactactccgcattataggcatagtaataggattacatttacctggcttccaaccaaaagcaacaccgctaacattaaaataaaatattctcatcatgaattagtaatttcatattaacagaagctaaaggcacctagtattttttgaggctcatttgcatatgggtatatactcagatttcttttccaaaaaagtagccatttaaagggaaccctggtgtaaaatttagaaaacagatgtagaaaaatcataaaatatccaaataagtttttacaaaattttcctatgctatttcctttatattttctttagtccatctccatttatgaattattcaggaaaaaaaaccccaaaatgattttccgtgttatagaagatcatactccaaaattgaccaaaaagcttcatttgttaagactgtaagttctatatgtgccattaaacatacttactttttctagacttatagtcccaattctgacgtttatatccaatttagagtgtcagactatttcttctctcctctattttagaggcagtctgaagtctttcaacaagaaaattttgtaatgaggtgggtttttttccacttagtgtttgatcaggaacaaagcatctaattacttggagcccattttctcatctggaatattaagctaatgctattttgtcaataggatttttgtaaggattataactagtctataaaacattatgcaagtatttgattctactgtcacaagaaccgatgctttcaaaaatacattaattcagacctcaacaccaattagatatataagcatttatgtgttatacctgatgctcatctatatatatacacaccctactatgtgtctgtaaatctctgtttgggagaaaggtgcaatacaccatgctaaagaatcaattattttcataaaggcttaactattgataagagatatagatataacattgagtgtttcacaggagttacacacacacataactttattcaatttccagcaatgtttcaactaaaaatattctgtcaaagtcaatttacataatggtgagattaaagtaaaactaagaaacgtcagtggataccagtagaatatgacagtttattaattttatttataacacacaaaagaaaaatatgttaaaaaatgaatatgctatcttgcaaacactgtctactatggcagacactaagaaaacttatttaataacaagactgaaattagatttccgtcagatgctgtctttagaatttggggaatagagctattcatccctggatgtgtttcttggagatgtgtcaatatcgtaacaatgaaaaacaaaattgctttataccgttagatatttctgatacaatctttgcccactcgtgggtttcataaagctttgtgccaattttgtcaccaagacaagtgtatctgatctaacacaaattgaacacttttcagcaaagcattgtgtatattatttaattccccattcatatgtcatgaagggaaccagcatggttaccacaataaatttatttaaatcaacaaaattcaatgtcagaatgtatcatttttttctatggtatacttaaggttccattaaatttactgacattccttcattttagaaattataatcccactgggaccacgattttcttaacatagaattgaatctaatggatattttcctcttattgacttgaggtaattaagctccccattgagaagaccaccagatagttttatttatgaagctgatagttcctaactatggcagagacaggctgtcaaacaaccatgtcctttctccagcttttaaagtatagatttttcacttagaagcagccactcagccagccactgcattatccttgtagacaggcatggctatatacatgtttcatgagcacacatccccttcatgtggaaagtgaagggagcacatatgcatcacctctaccacaaggcttctaagaagtcactgtggcttttctgtatttgcttccccctcttcaatggctatatgaaaaaacaaaaaaacaaaaaacatcatcatctgtgaagaaggtagagccacaacaaaggcagaaaaatatagaaaaatattagtcactgtaattagtccattttcacactgctgataaatacctgccgagactggacgatttacaaaagaaagacgtttaattcatttacggttccacgtggctggggtggcctcacaatcatggcagaatgcgaaaggcatgtctcacatggtggcagacgagaaggtaacttgtgcaaggagtctcccccttatgaagccatcagatctcacgagacttaccactatcaagaaaacagcacgggaaagacctgcccccatgattcaattacctcccactgggccactcccagaacacgtgggaattcaagatgcaatttgggtggggacacagccaaaccatatcagtcaccaataaggaacacctacattggacttatacctgggctacatataaactattgttttaagctcctttctattttggcacttatgtgttaaagcagcaaggttgtttagctaattcagtgacacgagatcacactttgtttctgatgatttaaataagaattaatagaattcagttgcaccaggccatcaagactaatcatgcccttggaaagatataagagcagatgaataatttttctgtgtcacctcaaattctgtggtactacagcttatagccaagtgatatattctagttttattagtaaattgagtaaacattactatccaggaaaaaccagaaaaaaaaaaaaacaggaggcttataataaatatgacattttatctttgaaatataaaccagcttcatggaatagtcatctttaagttctaggacagtggcaaagtttttaaaagattgaacacatagtcatcaccaataaacccttacttagtacagactatgcatgaagtactaaggtaagtgacttctgtaagataaaaacatggaggaaacccttttgtggttcaggaacatgtattcccaaggttggtgtaactgaaggttagtttaagaatgggtacagaacacatggtgggaagcaataaaaggcaggcatagaaagccggattttgtttagaaagaacatggggttgtattaacaagagaatgacatgcttagacctgtcatcttcaaacactaattgtggtggcatgtgaacaatgatttaaagtaggaggaaattagagactggaagacaagctaagagagggaactgtaattatctgggcagcagttttgggggatcatccagcagagaatgtagaatttaaagtaaattcctctagtattgctattcggaatagaaaactacatttacaatgatttaatacaatatacattaataccaaaagtatagtaagaccttagatgtaaaatgtttacgtgttcttggagttccttttctatgcttgatgatcaattgatgtattaattttagtttttctaacctaaatgtatttgagggcgctaattttgaaagcaatataaatatgtcgattactttatgagttgcataaaattatatacattagtacaataccaaatgtacatttggagagggaatacagattctattagtaatttaatcattcatttatgtttttcattaaacatttaagttcctactgttttaggaccaggagatatagcagtgaataaaatgtacaaagtccttaacttatgaagcttaaattctaggactagaaataaaaataaggacaaataaatatgctacacaaaatcaggtcatggcaagtcctataaagaaaaatagagcaaggtaaagagagggaacaaaaggcatggagaggttggctctacttaagagaggatttagagagggaaagcctttcaactacaggaacatttaaaaatagagttgaatgaaataagcagttgaatcctgtgatgactctctggagaaaacacatttccatattaaaggatcagcaagtacaaaggtcctgaggcaggacctctctggcacttgactcccaatgagcctggatctgactagaagtgaaggcatggagagcctatgattagcgcatgcaatattaattttgattacaaagttactttaaactggattagctttatctccagtgaaacacttttcagagaccacagacaaatcttttggactacatctaaacattttttggaaggattaatatttctataattttgaagccatgtgaaaattaagatgagtctattctcatttagtgatcatgccagccttagaaagactgaaactgattaagtaaatgaaagtttgtcacacttaaggtgtaactactacagatgaaaacagaagccactacaaacctagcaaactaagtagatttctaaagttttcagcaagtgaaaacataaatgtcatctcatcattgacaaattccctaatcccattttgttaatacacacacacacacacacacactctgccactactccttctgtgccccaatacggcttttttcaaactactattatatcaagggctgtgattatgtctttgcaatattttcagtgtctcacccctgaaagatgcataacaacaattggttaaatataactaaatagtattccctgtgatgactctccaaaatatacgagtttctgtaccacttttgctatttcagaggttgactattttaatgctagagccagagacacagtaatccaagtgacatgctcaaactaaaagcactgatcaagaatgagaggattttgttttatctttgaggtttatacattattcttctcaaggatgggctcaacatctaagtatcttacatgttaaatgaaaccattccaagtcaaaaagataaaaataccaatatatttatatagagcactaggaggtcctaactaagccagtgattttgatactctgactatgccatagccaattcaaggagtaatagaaggaaacacctgaaaccggtacagaagaagatagaactagaagaatgggctgtcaatgcctaactgatgagggcattggttggccattcataatttgaaatggtaaatcactagctatttcctaaagcagatactgctgtaaaagtttctgatttctccctgaggtcatttaaacaggtctttgcttcatttttgaatgccgttattaattcatgacatattctactatatgcacttacatcccacaagatgaatctcctttggagggcctattggcccaactactaatataagtcattgttagtagaattctacatctccctttcctaaccttttctttctacgtttacaagggggaacagcaattgaattaaaataaacatcatttaaaaatcagcaatagcatgagttacaataactagtctttactctgtactatatgaagtatttaacatacattaacccatttattattaaccacattgcacaaatgaggaaactgacgaactaattgcttgtgtaaagtttttaaggtcacacatctggtaggtagcagagctaggattcaaagacagtgcagctcaagagcctatgctctttactcttacatagaggtagacgttttaaagggacaaaaatattctgagttgatcatttctccctatgtaagtgaactaatatatcactccctaatcaatccctgtatcctaaagagttaatataggatgtaatataggatgatctaagaactcggatacaacagactcccccctatatcaagcaagagtcccttatgccaagcataattacccgtgatggctaacataaaatcgtttggggaaaataaacatatcaaattgtttaagctcaagtagatttacagaaactcgggcaaactcatgtgttccaagataacaccacagactgtcacagcaactcatctggtaagctaattctgaccaatctgtcgagagcatacttagaaccatccagctcagcgtgtaaaactcttaagtatccttccgtcatgctcctcttctgagaggctatgactattccctgaaggtggtgcttaccctttccctgtaaatttaacaagctcagctttgggtgatcaacacctttgactggaggacattacaggtgtttctatggtattcattcataaactaaaagtagagctgactgaaagcctggtatttatagctagcgagagaaatgtccaattattagatgaggttcattttcgttaattattttagttattatgactacataatagttgtacatttggggtgcatgggatattttgatacatgaatacaacatgtaatgataaatcagggaaattagggcatccatcacctcaagcatttatcatttatgttagctaaattccaatttaactattattttgaaatataaattattggtaactataatcactctagggtgctaccaaacactagatctgattccttctatctaactatatactttttatttttttttttttttttacctatttaccactccctccttatcctgtcctccccacttacccttctcagcatctggtaaccatcatcccactctctatctccatgagttcaatttactttagctcccacatatgagtgagaacttgcaatatttgtgtctctgtgcctggttgatttcacttaacaatgtcctccagttttattttctattatttttctttctctcgctctccttttttaaagctcctctggagtgctctttcttagttttcaatactatattttctgaacatgttttttaaaatctacatctggcatctgatctattcctacaacctatccatattctgtctgacctatatttttatttatactttaattccatttgaatttctgctctgggctttagtttacacttgcaatgtgtgatatctgatatctggcccatcctggaacagaagaaatatatcattaccaatggaaaaacacattaaatgataggaacataggaaagtcggtttaagataaatgggcccctagaaagatacactcgcacaacagtatgtacattatataaagatgttaagattagggatgtctgaaattccttaggagaaatggcctgctaaagggcaagggttccacgattgtaatataagagagttattcaattttactaaaaataagttaaaatatttttaataacgtaatcaacatttaccaagtaccccttctttcaagtaatgggactaagaccggagggaaagaaacaattcgtaagatgcaacttctccattaaagctgtttaagtccacagtcaattacactgaaacactgattccaagagcatcttaagttaatctggatttattctttctaggtagttctatcacttagtatacttatgtattagtccattttcacactgccataaggaatacctgagactgggtaatttagaaagaaagaggtttaattgattcacagttccgcatggctggggaagcctcaggaaagttaaaatcatggtgaaaggcaaaggggaagcaagcactctcttcactaggtggcaggagggggcagggaacagccagacacttaaaccatcagaacttgtgagaactatcatgagtgcagcataggggaaccacccatcccccatcccccaaatgatccaatatcccaccagttccctcccttgacacgtggggattacaatttgagacaaaatttgggtgggtacacatagccaaaccatatcattctgctcccggcccctcccaagcctcatgtcatcacatttcaaaacacagtcatgccttcccaacagtctcgcaaagtcttaactcatttcggcattaagtcaaaattccaagtccaaagtttcatctgagacaaggcaagttctctctgcctacaagcctgtaaaaccaaaagcaagctagttacttccaaggtacaatgcaggtataagtattgggtaaatgtttccattctaaatgggggaaactggtcaaagcaaagtagacacaggtcccacgcaagtttgaaatgcagccaggcaatcgttaaatcttaaagctcccaaatctgccttgactccatgtctcatatccagggcaggctgatgcaaggggtgggctcccatgaccttggacagctccacgcctgtggctctgcagagcacagcccccatggctttcacagtgcctgcagcttttctaagtgcatggtgcaagttgtcagtggatctaccattctggggtctagatggtgggcctcttctcatggctccactaggcagtgccccagtgaggactctgtggtggggggaagggctccaaccccacatttcccccctgcattgccctagtagaggttctccatgaggactccgcccctgcagcagacttctacctgaacatccaggtgtttccatacatcctctagacatctaggcagaggttcccaaacctcatttcttgccttctgcacagccgtaggcagaacaccacatggaagctgccaaggcttggggcttgcaccctctgaagcaatggtgcaagatgtaccttggccccttttagccaaggctggagctgaagcagctaggacacaggaagccaggtcccaaggctgcacagagcagtggggccttgggcctggcccaccaaaccatttttcccttctaggcctctgggcctgtgatggaaggggctggcacaaaggtctctgacataccctgaagacgttttccccattgtcttggctactaacattctgcttctctttacttatgcaaatttctgcagcaggcttgacttactccctagaaaatgggtttttcttttctgccgcatggacaggctgcaaattttccaaacttttatgctctgctttccttttaaagaaaagttcccatttcagataatctctctgtgaacgcatataaccgtatgttttcagaaaaagtcaagtcacatcttgaatgccttgctgcttacagatttctgccagataccctaaatcatctctcaagttcaaagttccacagatgtctagggaaggggcaaaatgccaccaatctctttgctaaagcatagcaagagtcacttttactccagttcccaacaagttcctcatctccatctgagactatctcagcctggacttcattgtccgtatcactatcaacattgtggtcaaagccattcaacaagtctctgggaaattccaaactctccctcatctttctgtcttcttctgaccccccccccaaattgttccaacctctgccagttacccagttccaaagtcacttctataattgctatatttatagcaatgccccactatctgggcaccaattttctgttttagtctgttttcacactgttataaagagtacctgtggttgggtaatttataagtaaaagaggattaatagactcacagttctacatgggtggggaggcccccaggaaacttacaatcatggtggaaggtgaaggggaagcaagtaccttcttcacagggcagtggggtcggggggaaggctgtcaaatacttttaaaccatcagatcacatgagcattcacacactatcacaagaagagcatggggacaaccgcctccctgatccaatcacctcccaccaggaccctccctctacacgtggggattacaatttgagatgagacttgggtaggggacacagagccaaattatatcaacttattaatgcagaataaattgtttccaatacaatgagaaattttccctaagtttttctatttgtgacacctcaaaactaaaccactgatgttctcaaatgcttaattaattaaacaaactcatccaaccaaaaatatgcttgtgcatgaaagctgatgttttatggttacaaaaagtaaaacaaaatagtatgaaataaggaaaacatactgcattctatgcactgataaaatgaatgaagctaaatgggtcataaaaaagtatatccagttttatagggcgtgaggcctatatagcagcataaatttgtcttttttttttgtttttacagtaattaagagtatgcaacacgctccacaattatctgagtaattagattttctcaattaaaaacgagcactgataagattagctggatttctaggtcactttgtttcgcagcattatcaatttatccaggtcagaatcttacatctagggatacagactggactggaagttcctagtttttaagtttggtttctggttggggggggaatcctaccaagctaggaaattaatgggaggatgcaattgaaataactaggatagtacttaatgtgttgtaaataataatggcagttattactttgtaaaaacatattttaagcaagtatggaatttctcagaaaacttaacctcaaagcaaaaattttaagattgtttatggtaagaatttaatatcattttccatgtattctcattcttactgttattatttcagtcattggggaaagttatgcttccttcagatggggtgattagaataaacaagaataagacctctgaattcaggacttcgcagttttccaaaagaaatcggtattttttaaacttttaacagattactcctttctattgagcaaatctttacctttccaattggtatttagacatgtaaatttaaaacaaagacattcttctgcaaggaaatttcagatgcttccataagcatttgaaacagcccaactgtttttgcatacttaaggaaagagctatcttaaggatggcaacagttactgtgtaaaaattttagaaatccttttaagtatcaagtatacattcttatgccctgtgcacatcgctgctcaattttggatgtccagcagtgtgcgcacgtccatgtgtgcatgcacataattatatacccatgcacatgagcacattcatttaaccatacaagaagcaatcccagcaagaattctaaaaaactgatatatgtctgaatattactggaaaagagactgtaggtgagacctgggcttcatatggttcaacatagatttgtcagttgatgctgttaattaaaaataatacagaatatataggacaaagtattgtgtgttgatgtaattgtcccatgactgtgccaggtaagaagcgtagaggataatattccctgaaaacagtagggatttctactgctaaacatcttttaaaatgtcagatcctcgcaaaaaaaaaaaaaaaaaatatggactttcgtctagggtgagggaaaaagtttttcccttcgtgccttttgtgattcaagtcccgaaccctatagaaatgagcactgctggacttctaccattgagggcagtttgtcaggccccaaagctgaacagccaagtacaacagaccagagctaagaaactgaacagaaaaaaaactacagagagtgcagtagtattcaattactgttgtaacatattcccaaaatcttaatggcttaaaacaagacaaatgttttatcttacagctgagtaggttagacatctgacatgagtcttattagactaaactcaagcaacagcagggctttgttcctttctggaaattctagaagagatcatgtttctttcccttttctagcttttatagacctccaatattccttaacccctggtcttcctccattcttcaaagcgaacaacagtaggtatagtctttctcaaattatatcactcaggcctactcttgtgcctctttcatttttaagcattccggtgactacatagtgtgcactcaggtaatccaggttaatctccctccctattttaagatcagctaattaacaaccttaattcccctgtgtcatgtatcatgtactatactcacaggttctagggatttcgacatgagtatccttggggagccagcatccaactaccaaaggagagtttaaatatgcaggtttaaacaaaaaagtcgtatcatattgagtatccagatttcactttgtctccgatatactctaattctggtattcccaagtattaaatatcttgggcaccaattatttttgtaaactggtgcctgtaataaatttgactaaattaagctgattatttaagctaattgttcatgtatgaattatttcatcattccactgataggtggcacagtagctcacacaattccaagagatttagtttcaaatgaaagtcgtcctattcatcccctttattattgattttactgcacacacacagagagtcattactagatgggaactgataacaatgttgctcggacacacaatgacacctaatatttatattaatatgctagcacattttttctgttcctattttttgatagctgcaaattagtcttttgtcgcacattccctttttcatgaggtttttaaaatgtttaataaatcatctacatatttaatttttaccactagcatttagacatttttaaagttatcttttgaaactaaattatttttagattttacagatgttcccccttcctgtgtccatgtgttctcattgttcaattcccacctatgagtgagaacatgcggtgtttggttttttatccttgcgatagtttgctgagaatgatggtttccagcttcatccatgtccctacaaaggacatgaactcatccttttttatggctgcatacggcctgtggtggggtggggtggggtggggtgggggtatgggggagggatagcattaggagatatacctaatgttaaatgacgagctaatgggtgcagcacaccaacatggcacatgtatacatatgtaacaaacctgcacgttatgcacatgtaccctaaaagtataataaaaaaatcaaaaaaagaaaaattttaaagattactattcaagatattcttgggaaaatatttaaattataataatcccaatttaaattatactttaattatgtggtcattttatattttaacttgtcatgtatcttctcccatacaagcctgatataaattttacatagaaatcatgatctgtgtatccatatacttctcccctcatagtacacacacttacccgatatgtagtgtgtattgctttagcatactcaataaaatccattgagacaaaatatgccttatgtttctaattgtaacagtcaatttttaccatataaattaccaagaggatttttctaaaattatacgatgaatgtagcaattacacaatctctctacaacttttgtaccatacatggaattctatactagaagccgacattcttatgcccgacagaactatttagttcattttatgagacgtgctattgagttttagataaagtttgaaattttataacagcttattctgtaagaatgcatacaattatcaattaccttgggaataaattgttttacatatttctgagaaccttctgcagcttcttgtatatcaaaccacaggtatatgttttagcatagttaatattttttgaaattaccttcaccactgttattttatttaaataaaggtaatcaggaaggcctttcttcagcttagacaacaaagtagccagtaagatcaaggaaaatattaggtaaaacccaaatacaacttcaatacttggatactgaccatttcattgcttgttaatgttaattccttggattaatcagttaatttaatctatcagcttgataacgtatctgatcagaactttaaaatcctaactggtcttcacacatattaatgaccctcacactttcatgtaatatgctaatgtaaaagccgtgtcttcaagaaacatttgttgtacattaaaaaacaggcactcgcactttcagaggccgaggcgggcagatcacgaggtcaggagatcgagaccatcctggctaacacagtgaaaccccgtctctactaaaaataaaaaaaaaataaaaaaaaataaaaaataaaaaaattagccgggcatggtggcaggcgcctgtagtcccagctactcgggaggctgaggcaggagaatagcgtgaacccgggaggcggagcttgcagtgagccgagatcgcgccactgcactccagcctgggcgacggagcgagcctctgtctcaaaaaaagaaaaaaaaaaaaaaaaaaggcactcttatgctctgggaattcagctgtgaataataaaggtcccagcacatgaggaagtcaccaccaataacaggactgaacaagtctacaactacctacagcattgtgataggccagcagtactatggtgggaacaaactccactggaacattaagtgagaattattttttgaaggttaggaattttacgttggattaaatatcaatgatacaatcaaagtgaaacatgagaaggactcatactgttgtttactctgttaatattgtactaaacagtattgaataaaacaaaatcaacgaaacatttgaaaaacagaagacattgtatctttaaactagtgatgtcattttcttgcattctcatatataactcaatataccgggaacactgtagattctaaataagtattatgtaattaagtaaataaattctcccttgcctctactccagtaatccctcttcccttgctgctgcttgtgaatgtgtcagcctctctcctgcaaccaaatttctaccccagacatactacattcgtcttattccatctctccatgtattgacaagatgggcacatgagtacgtgcacacacatacatccgcatactaaggcaaagtagcttactttacctatctcagagagaaaactagcctaaacataaggaagaatgctcactaaagattttaagatacagataaagaacatttgagtcacctttaagagacataaattacatgttcactccactttctctctatttccccaaatatatggtattctcctcaaactaagatagcaagatatctcagttgatatcttaatacactcagtattcatgtaggctcccaggtaagaaaaaaattattattgttgcttgtctaatcctagttgcatttaaatatgaaatagtaacatggtaattttttagaataaaaaccaattttgaatacaatctaatgaaaactttgaaaaatgttcatttccaaagataaattaaagacagataatttcacagatcatgctctcccttaacattaaaaaggttcttttctcatatatgtattaaatattatcattaaaaatcactagaatatcaaaaaaacagcctacagacttggtgtgtatagtatgtgataacataagcacaaaacaaaacaaaaaactaagaatagtttcaatatgtatgcagtaacagagacacatgctattctgagaagggttaaatcaacaaaggacataatctttctggggttcagctgtgaaatgcagagtggaagaacaacatcccagggagttggaacagcaagtgctaaggccttaaactatgtaaatatcatgctagatgattgtgtgtaaaagagaattaagttaaatccagaaagaaaatagggccagtcattgtcaagttcttcctgcagtcacagaaaaagatgagaataacttgaactatggtggtggttgtacaggtggagaggtatgaatgatttagtgatatacagtgggccctccgtatctgcgggttctgtatctgcaaattcaaataacctctgatttgatacaatagggtgaatatagtcaataattgtgcatttgaaaataacttcaagagtgtaattagtttataactcaaaggataaatgcttgaggtgacatgctattctcatgacgtgcttattccatattgtatgcctctatcaaaacatctcacgtaccatatatatatacacacacacgtatatatatacatatacacatatatatcatatatacacaaacaccccatgtacccacaaaaattatatacacacacacatacacacacacatatatatacctatatggtgtgtgtatatatacacacacacgtatatatacatatatggtgtgtttatatatatacacacacatatacatatatggtgtatatatacacacacatatacatatatggtgtatatatacacacacaccatatgtatatacatatatgtatatatatataccatatatatagatatatggcatatacacacatatataccatatatgtatacatatacacatatgtgtatatacgtgtatacgtatatacacatatgtgtatatacgtatatacacatatatggtatatatacaccatatatacacacatatatgtacacatatatggtatatatatacacacatatatatacacatatatggtatatatatacacacatatatatacacatatataccatatatatacacacacacccctagtatgtacccacaaaaatttccaaaaaaaataaattgtttcccaaataaaaaaatattcaggaaatacaataaaaattaacaggatagaaatctccctgttgggtactatgcttattacctgggtgacaaagtaatctgtactcagagcccctgtaacacataatttatctatataacaaaaatgcatgtgtaaccctgaacctagaaattaaacacaaagaataaaatgtaacaactatttacgtactatttatattgtattaggtattataagtaatctagagataatttaatgtaaacaggaggatgtgcataggttatatgcaaatatgacatcatttatataaggaacttaagcatccacagattttagtatctggagttcctagaaccagttctcagatagtgaggcacagtcgtattcttaaagtataatctataaggcatcatggattgaaatagttctaatacttcacttttttcatacttaaagctgcttaaatgaccaacttaaaagatagatttattattacagagatttcccgatccaagctattaatgtcagtgcagacatggttgattcatggagcgggggtgggggggggaaatacacacctggaactcatctgtgtgtttagaggacaaattaaatcatttttaaatagccccaggatgatctcagccattaaagagcagaaggctaataaaacaactgttcctattaaatcgttttctgagttttataagtagatgtcctcccttatgtattttattggcaatatatgttacctttatagagaagcagcgtttctatagctctcaaaaaggttaagaacccgaggtgtattataggccaatttctcttgtaaatgttgacttaaaatagtttaaagagcattttctcatgttggaggtgattaattgcactgagtttcacttgtaaaaatccattgctcaaacctaaggatggtggggggacacccatctgtgcaaacgtgtggacttacaatgacttttgcttatgttagctcaggtgtcagttctaatgaacaactttcaacaagagaaaataaatccagaactttttattagaaatcacacatgttaaacagaaatcattaactaaaccttactcaaaatagtggtggactttatcacttaagaaatcaattaacttccaaggaactatagaaaaagttaggttcccgctccaaaatcatcttatcgatttatgcatttatgtccaactaataaaattagggaagcagagtaagaactactgtatggatccgtggattttggtatatttaaaatcccatataagaattatgatgcagccacattttcatttgacataaatatttgtacatttattagaatgaaaaacatgctctgtactttaaaaaatattctctgaattagttcacattctgtcttatataacagttacctatatattgtttgttggcctatatgcaattttcaataccttggcagactgtatatcttttacttcctgacacacttggagtatatagcactattccttatgtaaagttatcaatagacatttgatgaattaacatgcatttctactgaacaaagtaagcctggggcacataactttaaaatgcttatgtagcatctgaaagaatttacaatgtcagactaagaataaaaagtaggggctccagaatttctactttattaatgatgtggtcaaatcaacccattggaaaaaatcttagtctactcagccacctgcacaaatgctcgtgctctataaaagcattaaaaaaaaaaaaccttttagactagtctatatgtactctgcagagtaaaagacacattagctaaaacaatagtgctcataatattaatgtatttggcttgtgtaagtaacaatatttaagctctgacaataattctaattttaaacattttcattccatctgcaagattaaagtttgaattattatgattattcaatgcctcttgatcaatctgaggaaagatttctttcaataagaacattccttcaagcactacctttgctatgttcttcactagtctatgttaagattaacgtgaagaaggctaggtaaggagtattatcatttctattataatgattttgcttaaaatgtacatttctgtttatgatgaatgcaaagatattatcatttaatggaaaatttatgtaagacagatctcgctacaactagctttagcagttttacttaggttataacaatttaaaaatttctcatcttatagtcccttaatattccatattttttaacttttttcgtatttcacatgcagtttgttggtgaaagcaaaattcgagatataatagagagaaaaaaatacattatttatttttatccaggagcttatgtctcatttttatatcgttgttatattttgcaatgggtgaaatttgtctttctcttcagtcttttaaaacctagttacttcaccaggttttttccaaatactcaaatgcccaatcgttatttttctatactagttttttccccacttctggctgtctcttttcagagtccctttgattaacaactacaacaatatcatagtctgctgtttaactacagtgaggtgaatttattaagggcttcaccatgtactcttgcctcttgaggaggaataagagtgtgtgtgtgtgtgtgtgtgtgtgtgtgtgtgtgtattccaattattaataaaaacagttttcaaatcacttttccaagagactcacttgcccaactgattctatacagaaaaacttagatattaaagcctaggtaaaatgtatctttttatttagactttctcagataatagcttttttttttaatccacatatgactcaaggtgggatttcaatctagataagagatgttcacatcacgacctcactgaggaaatatttgagatagtgagatgttttgatgcctttgccatctaattttagagttaactgagaaagagtagaggggaatattttcataactggtgagtgtctccctttgataactttagtgtggcttggatagaatgtcatacttgcaagatttgtaaacatccttctactttaattatttaatgattctctcaaggaaacatcatagtaaaaagaattcagtatccctcttattctggctctagtttataaaacttttccatttattttcaaaacatttggaatcaactgatggatgtgcatccaattaaaaacaaacccaattagccctgtaataaaatgagtaaccttttagttaatgcaaagaaaatattcatggaagaagagaggaatattctgccataagattatattctgtagtagttacaagtagggaatcttaactccaactcactagctgagtgatgtgggcaatttacataaactcttcagttgcaaatgaccaaaataatagtctctacctcctagagtttttgcagaaataaaacgaaattatacaatatcaagcaatgtgcccagcacttaatgtttaataaatatcacaccagattacatcaatattactatgtatgtattactcccagcttcagaagttgagtttttctgagagtctgggaaccaattcaaccacttttacgatgtcatatgacgtaatgactacaagagaaaacctagttatacttttgcaagtgtgctaactaatgtcttacaaatactatgacaattataaggtactatcatgaaccagccttcaggagacttgctagaaatctaccatgtatccatgacaactgtgaatcaatctctctgtcaagtgtgtgtgtgtgtgtgtgtgtgtgtgtgtgtgtgagagagagagagagagagagagagaaagagagagagaaccactctgaggaatttaagatatagtataaatcttttatgaaaactagattagactctggagctcaaggatatcaaagattaccacccagtacaccagctgtgagccagcagtattcctcagaccagaaaaccagaatgagtgggaaggtcacaggaagaccagcaagatttcaaatgggaaatgacagtagatcccccttttccacgggggatatgttccaagacctacagcagatgtctgaaaccacaaataggccctatatatactgtttttcccatacatatacatacctatgataaaatttaacttataaattaggcacagaaaaagattaataactaatagaacaattatagcaatatgcagtaataaaagttacgtgaatgtggactctcacctctccctgcccaccctccccaccatcatctaattgtactgtactcatcaatttaaggaccacggttgaccatgggtagcagaaactgtaatgaataagggaggactcctgtatttaatttggggagagtcagcatttattctagaggcaggcaaaataactggaaagatcagttttccctacaggagtataaagggaccatttaatttttacaacattccagttatttgacataactttagctactgtttctgggctcatattacgggccaaatacatacaggttttacttactccttgaagtagcagtgggaggtaaatatttttactttacacgtgagcaatactgagcctcaataattttccagtggcctaaaactaataaaggcaaaaatcagattttaacccaaaactagttggctctgtgtagaaaaagttaaatcaaccctaggttaatctgatgctgcctaggaaaatgaacatagaaacttattttcttaggattaagagttaagataatagtagaatttcttgtcactcttgtttgctaggtaggactactattaaattaactggggagtggggcagagaggcaatatatagtcttttgtcctatgtgacaacaatggtattaaatattggtgggaaattaatgctgcaatttcttcatgtcaagtaaaccacactgattttggccgttgtcctagcagctatatggagcacatttgggtgagaggcatgtggaaatctgtatgttggttgcttctgggccatccaatgatacaaagattctatgacagtgtatctcctgccttgtatccttctgtacagctaagtaaatgtcatagattaaattctattccatctgtgagtataattgccaattttatctccttacaactacactaacagtgcaggctccaaagttcattatgtcctgtcagtaaaagttgcatatctggctaaaatacaaactgtttagcaaaactaaccctggataaatggtaaataaattcaacctatttatggcattaatatcagagatcataaaattaagccatttgcttatttcaagtggatttatgggatcagacttctaatttgaaaactattattttaccatcattttaattgttttcccttattagcccttagttattattaaaaattcttctagttctttatcagctctgccaatgaaagacatttttattggctgcaaaaggcatcaacaaacctcagatagcagaacacagtgatgtcaattagtaacaagatgagagaggcaggcaaaagaagaaataaattaaagaacaaagagtcagggatcacctctgcaaacagctcctctcacctgggcaacccttgctggaaactgtttgagtcagagtaccattctatcacaaacatgtccgtgaagcaataaatagaagaaggaatgaagagagacaactgtgcagacaggagataaggcaagtttcttaatcctaaagagaatgttttgatggccagtcttatgtgacagctagtctatttttactttgtctgtggatgaacaatttctcattaacagaactgttagcaataagcagtactccagtaattgaagatgtgaacagcaggcttagtcattttttaaggaagaaaatgctagaagtctaaacaaatgctgggacaacagattctggatcttatcctataaaagggcatatctcacagaaacaattgttccattgtagttgtttctatcttagctgcaggatactctcacttactgagcttctaaaaattgctgatgtcacagcccgtcctcagtgaaataaaatactagtttcaatcccagtgttgccataaagcttccccaaccgattttattggacagtcttgtgagaaataacacggactttaagaagagataaaccctggatttgattatagctcagttatctattggctgtgtgatcttgattttaataaagctctctaagcctcagtttttccatttataaaagaaggataaacttacctggaattgttgtgtacaagacataagataaagtatggaaattatctagaacatgactgccctacttaaacatttgcactcttctaccaaaaggaacttgcaaatttgagtttatatcactgatgataaattagaaaaatctttgcaggggaaaaatgtgctttgatttgaagcaaaagtttattcagcaatattaacatctcacaagaatgatattacaggatatttcctaaaagtaaaaacactggtttcaaccaccttattaaattgtaataatatataaaattcctaataatttaatagttgtaacagttttctcacttttcaactggatatcatatgatccactaactccacacgattgccataagacaaaaaatctggggcttcaaaatggctgaattgatggatctgttactcacctcttccatggagaggaaccaaagtaccaagtagataatcatactttgaatacattaactaagagaaaacactgaaattcaacagagaagcaatgaaaaccactaaaaggaaaaagaaggaaatgaggcactctatccagctgagattggctaggagtctggagaggctccctaacatggggagagaattagagatgcacaaaggtacacattcttgtacaagattcctacaatcctagccaattgagagcccttcaacccgtgtgggcccccaaaccaacacacagctgtctagatactgtgcaaaggcattgcttcacggaagaagcccatgctgggttccacaaactctagagtcctaagcagctgcaacatggcctggttttgagagcccagcccccaccagtctatgtcctgacctaggactaaaaatcttccctatctccacattcctggagtctcagtgatatttcccacccatggctgcaactgctggggccaaggcaggaaccactggcagcaaaccctcccctgcccaacagaggggtggccactcaacttcatgcacactgaagactaattccactgcctgcaaatgctgtcactgtgaactgctgtggagttgagacacaagcgacgcacaggctacccaggcaactgcttatggctgctcccaaggaaagcaaccttaccctctccagtagcagggccacagtgtagccaacactgccttccacctgagcattgcacaagggacctggggagcaccttgcccctcgactacaataaccagtggttgcatgcaccaccaggagtcctgaggacaggtcttcccagctctgctcttccaaatcccccagtacataaaaatttgtatagagacctggggctctcccaccccagtttaccaccattggcatctgactagtcttcctggggcctgaatttgggcccactcaagcttccactaccaccaaagctggcgtcaacctacatgcaccatctgcaggcctaggaactggcttgcccaatctgttgcatccaccaccaacaccatcatggattgcttgcattccagagggttgcccccctcccactattgccattacccgcaccatgcttgctgcccctgggctgggaacctgtgtacccacccagcccacctatgcttttcctgacaaccaagcaagccacctataagccaaagggttagcctgcctggacacactaacatcaatgccaatgtacacagctctgaggcctgaggacaggcacgctcaaccaactgatgccaccactggggcctgaagactggaccacttggtgtcccagtcaccggcaaaacttcaccacagcttctgctaacaactgcaccctaagctactgaggaagttacagacaccattcatactgtttacatccaaagaaatcatacaggaagtatactactatatacattcagaatcaaaggcaaagactcaagaggagactagataaaacagaagaatctcagaacatgaaaacaggtcttttaaaataacctactcaaacaaaaaataacaaaaaattttaaaaaaatgagcaaagcctatgtgacatatacaacaccataaagccatgaaatgcttgcattttttatgtcctagaaggtaaaggagaaactaaaggtttagaaaccctatttaacaaaataatagatgaaatcttcccaagtctagcaagagatttagacatccagatacaggatgctgaaagatctcaaaaagggatacaattcaaaaatgtcttgtccatgacacattatagccaaactctcaaaagccaaagacaaaaagagaattctaaaaacagcaagagaaaagcaccttgtcacttataaagaaacctccatcagattaacagtgaatttctcagaagaaaccttacaggccagagaagaatgagatgttatattaaacttgctgaaagaaaacaaccaccagccaaggatactctacccagccaaggtagccttcataaatcaaggagaaataaaatagttcctagacgagtgaaagctgtggaaatttatcaccatgatactggccttacaagaaaggtttaagggagtcctatacctggaagtgaaagaatgacaactaccatcatgaaaacacataaaaatataaaaacaactagtagtgcaaacacacaaaaaaaatcaagaaaagttactcaaatgttaccactaaagaataccatcacactataatgataatgagggaaaaaaatgaagaaaaaatattcaaaacaaccataaatcaataaaatgaaagaaataagccctcacatatcagtaataatgttgaatgtaaattgattaaacattccacataaaagacataaactggctgaatggattaaaaaatatataacccaaaaatattctgcctaaaataaactcatttcacctgtaaagacacatatagatttgaagtaaagggatggaaaagtatattttatgcaaaccgaagccaaaggggagaagcagcagctatgcttacataaaacagactttcagtcaaaaacagtaaaaacaaacaataaggtcattatataatgataaagggataagtttagcaagagtatataaaaattctaaacatacatacacccaacacgagagctcccagatatataaagcaagtattagatctaaagggagagctagatgcaaatacagtaatatctgaggacttcaacaccccactctcagcattagatcacttagacaaaaaattaacaaagaaacattggcttgaaactgctccttagaccaaatagtcctaacagacacttataggacaattccttcaacagtcatacacatttttttctcataagcacacagaacattctccaggacagaccatatgttatgacagaatatgtcttaacaaatttataaaaaatcaaaatcatatctaatatcttcttaaaacacaaggaaataacaaaaagagaaactttggaacctgtacaaaaacatggaaattgaacaacatactcctgaatgaccattgggtcaaggaagaaaattgaggaaatgttttcaaaaaattattgaaacaaatgaatatcaaaatataataacacctacgggatatggcaaaagcagtgctaagggggatgtatatagcaaaaatgctcacatcaaaaatgttgaaatatttcaaacaatctaacaaagtacttcaaggagctagtcaaagaaaaaaaaacaaaccaaacccagaattagtagaaggatgaaaatcctaaaaattgagcaaaactcaagaaaatagagagcaaaaaatacaaagtatcaatgaaatgagaagtttgatttttaaaaagatgaaaataaagcacttgctagactaaccaagaaaaaaaaaagactcaaaatcataaatgaagacggagacattacaactgataccatagaaataaaaagttcagagactatactgaacaactattaaataataaactaaaaatctagaggaatgtataaattcccggacacatacaaccaaccgtggatcaagaagaaatagaaaatctgaacagatctataattagtaatgatcttgaatcagtaatcttaaaaaatttcccaacgaagacagtccaggaccagatgtctttactgctgaattctaccaaactttaccaattctcctgtaagtgttccaagaaaaattgaagaggaaggaattccccctatctcattctatgaagccagcattaccctgatgccaaacccagacaattatgcaacaaaaaatacaggacaacatccctgatgaacactgatgtagaaattctctacaaaatgctagcaatccaatagaacataaaaaatgtaatattatcaagtggaatttatcccaatgatacaaggatacatcatacacaaatcaataaatatgacatattacatcaaacagaatgaaaaacagaaaacatgatcctttcaatagacacaaaagaacatttcataaaatttaacatcccttcgagataaaaactccaacaaactaggcatacaaaaaaaattaacaaaataaagaccatatatgacaaatctacaagtagtatcaaactgaatggggaaaagctgaaaaatttctccctataaaactggaatggtcaggcgtggtggctcacgcctgtaatcccagcactttgggaggcagaggtgggtggatcaatagatcaggagatcgagatcatcctggctaacacggtgaaaccccatctctactaaaaatacaaaaaattagccgggcatggtggcagatgcctgtggtcccagctgctcgggaggctgaggcaagagaacggcatgaaccctggaggctgagcttgcaatgagccaagattgggccactgtactccagcctgggcaacagagcaagactccatctcaaaaacaaaaaaccaaaaacaaaaaaaagaacaagacaaggatgcccactttcaccactcattcaacatagtactggaggtcctagccagagcaatcaagagaaagaaatacaaggcgtcctaatagaagaaatcgttgtccaagtactgctctttgttaataacttatagctagaaaaagctaaaccctcaccagaaagctctcagatctgataaataaatttagtaaagttgcaggatacaaaaatcaacatacacaattcagtagcatttctatataccaataatgaactggctgagaaagaaatcaagaaggcaaacctatttacaacggctggaaataatacctaggagtaagtttagcccaggagggaaaggtccgtataaaatacagaacactgacaaaacaaattgaagagtacaccaacaaatggaaagtcatcccatgtttatcggtcagaagaattaatgttattaacatgatctttctactcaaagcattctacattgaataatgcagtccctatcagaatacagaaatggaataaaaagtgatcataaaatttgtacgatcaaagaccagcagagagcctgaatagccaaagcaatcctgagcaaaaagaacaaagacttatgaatcacactacttgacaaaacagcaaggtgttagaataaaaacagacatatagaacaatggaatagattagagaactcagaattaaatccatgtatttacatacaacttgtttttgacaaaagcaccaagaacatgcattagggggaaggacaccttcttcaaatggtgctgagaattggattgtcagatgcagaagtatgaaactggatccctgtctctcaccatattagaaaattcagctcaagatggattaaggatttaaaggtaagacctaaaactgaaactacatgaagcaaacatagggaaaacagacaggaccttggtctaggcaaagattttatggttatgacctcaaaagcgcaggcaacaaaaacataaatagataattgggactgtagaaaatgaaagagcttctgtaaaacaaaggaaggattcaacagagtgaagagacaacctgctgaatgggagaaaagatttgtaaactattcagacaagagactaatatctaggaaatacgaggatcccaaacaatttaacagtaaaaaaataatcacattaaaaatggacaaaggacaataataagtatttctcaaaagaagacaaatgaccaacgggtatatgaaaaaatgctcaacatcactaatcattagggaaatgcaaatcaagtcatgatgagccatcatcttgccccagttagaatggctattattaaaaagacaagaaaacaacagatgttgacgaggtgcaacgaaaagggaactcttaatacattgttgtagttcagaatataagtcagtatagccactattgaaaacagtatggagaagatttctcaaaaaactaaacatagaaatagagtatgtgtcagcaatgccactaataagtatatatgtaaagggaaagcaatcatatacttttctaactatcaggaaaagtatatgcatggcatacctgtacttgcatgcttattgaggcactatttataatagcaacttaagtgtccattagtgaacaaatggataaagaaaatgtggtacatatatacagtggaatactcttcatccataaaaaagaattacattttctgcaccaacatgaatgaaactgcaggttattaagtgagacaatcgaggcaaagataaatagattttacattttcttactcatatataggtgtaaaaaaagttgttctcatggaaatagagagtataataagataccagaggctaggaagggtaggaagggaatataaaaaggggttatttaatgggtacaaatatatagttggaaggtatatattctaatgttcaacagcagaaaggggtgactagagttagcaacaatatgatgtacatttcaaagtagatgagagaactcaaaatgttcacagaacataaaaatgataaatactcaaagtaatgaataccccaaatacactgacttgaccattacacattcagtgcgtttaacaaaatatcacatgtatgtacatatatgtaaaacgttatgcatcaataaaaataaaagttctaaaaagagaataaatctaagaggatagcttattgctttaaaataaaatgacaagacaactataaatcttcaggtttccctctgcaaggaataaatcctattgtatgacaattaaatttccctcttataagatttaaatgacatcaacaaagactttagttcatcattattttacccaaatattgttgtaaaatagtatattttcatcttatatttcatgttccagctgtaaaatgtcacatgcattttatatatagaaattatttaattggaaaacatatgtaccaacctaatatctatttttccagtgcccagctttaaggtttttggatattcatttgcaggttctgtgatgtctttttttgtttgtttttgtgggatggggggacagggcctcagttcttttgcctaggcttgagagtagtggcacaatcatagctcaccgcagccttgaactcctggcctaaagcaattctcctgccttggcctcccaatgtgctgggattacaggtgtcagccatcacacccagccctgtgatatcacttataattatgtataaaacacagttaactccattttgaagacagtgaagtaagttttccaactatcagcaaaatatacattacattcaaatattatcactgacttaaaaccacatagaaaattttaaactacttatgccattttattctcatttaccatcattagaatggtcaaaatgtttttgccaaggcaaaattctgtgacaagaaacacagatatcaactatagaacacttttctgaatcaaacctaatatctcatgtattccttcatagctgaaataaaattaacaaataccaatagatgtttttaatatatttctttagtctcatgaactcattgtgatgatatgactaggaaaaccatccacaaagtgtctattacatattatttagcattagaacctcatggctgcatttctcattattaatttattaatgtcttgtcaatcattcaaaaatcacttaatgtcactgtataggccaaggatattgttatttcacctgtaattaaaaaaaaaaagttgtgaaaataatcctggtaagctaattgaaaagagattctcagttatctaggtaagaattatatttaaatgtttctgaacaaatttggcatagaacctaatccataatgcacatcttcaatcgcatgattatacttcattatttaaattccccaactgagtaagaaactcttacttaactaaagcatactttaacaaatcagcccctaggggagatagaaattataaattgaccattttccataaagttaaaatggtgacaaatcatagaagaatgtgaaagattagtagaaaataccaaaatttgttataaagggtaaattcaagccaggctcccgcacacacaaatatcatatttaatgtttttcaagtctctgttgtctaagtaggtgaatttgggacagttacatgcaattatttgtcatccaaacaactgaaatggataaggagaacaaaaattgctttcatttattagtgactggttccaactgcccagaaaatactcagtttttttatggtatctgaactgagaaagatgtacaacacataacatcaagagaacacactggaatactctcatgcctcttctaacttttaggccactgggaaataacatttacgtcttaatttttgtcatgaagagcaatttcaagatttcccatcagggaagaggaaattgctacaataatatctgaatgttaatataatcatctgtatcatacctatttggtatatattactttgtcatcaaaaaggcaatggccatttttcattcatgtaagtgccagtgaaatattttcttaaatattttcttaaatatattttcaactgcagagtttgactctaaattgtctgaaatatttacagtaaggatttctagttgaaataccgtatatagagaaggaacacctataatattgcaatcgcattagattttctgaaaacaaggtactctataatgagttctagacaaaaatcaatctaaatgatataaaattagtgtttatgttcacaaaaatatttatttatttaaattaactctaatcctcctgagaattaaccctctcaattttaacctgtgtaaacttataaacatttcttgccattatggtatcaaaatgtgatgattacagcagaggcggaaaaaagttaaaacagcccttgttcagccaattgatatcaaacccaacataagaggccttaaaaatattcttctcttttatagcaaattctatgtatctttccatgattatttttgtaggttaaaatcctgcatgcatacaaagccaagtctgaaagcattcactccaggagtaaaactttccaacaggcagagctaattcttggaaaagaaggctataaaaacaactcaagagtgatgcagggattagccaagcagaaaatagaatccgtgtcaccattctcaggaagtcaaaataaaggggattaaaaccaaaccctaacgggtttgtaaatgtcattttgaggatacaaaaatttctctcgagtcctagtgtccttccttttttggtcaaatttgactgtcattattcatttttgttctaaagttaccctggtaaataagtaagaacatttccatatcatatttcatatcctaaatggaaatggctttctacactaatattcaaaagacatctagaacaggcgcaatcttttatccctgattttttgttttattcctttaaagagaacatcctcactttgttattcacaggggaaagctgacaaagcactctcttaatatagggaggattttttttttttttttggactggcaaacaaaccaatctgtttgaaactcagagaaacaatgtatatgaaacccacgaccaacgcatgtagaatgtactgtcttacagagaaatcataacgggaagagaattgtctgattcacaaaaggatatttttaaagagatatacctattatctatgagcataaacatacataatttattaagtttaccctagatgtacttatttttgcatatgttagcatctaaacacactagaaacagctcctgaaatcgcttatgctaatgcctactgctactcattttaaaaggcaattccacttaaaactaaacctcaggcctcaaaacaccagttaaggccaaagcatatcaaattctatatatgaaatcctacaaggtttcaatgacttcctaattttataaagcaattctatcaacaaagcttatgtttaaaattgtcaaagcattatttggcaggtatttcttaaaccaaatatagcttcaatcccccaataataaaattctccccaaatgtttcattattctcctaaggggcataactaatttaaaatgaaatttctttggagagtagccaacatcatgcataagctacagaaccaatatctggttaaataaaaatatgaacatcacaaaagcaattactatacaggcatgaatcacgaattttgctggtaaatctatcgaagagagtgttctaagtctgagacttcaagagatggtgttctgtcttttgtgactaagcagtcagtaaataaaaattcttatgagttattatttttttctttgaatcatcattgagattatctcctgaaaaatgctgagcaaaaatgtataaatgtgtacttggtggtttccctaacacaatggcaagaattgacatattttaaaaatatatgacttatgctgaatcctcatcttatttgcagccataagtaaactttaagaaactttttattattatactttaagttttgggatacatgtgcagaacgtgcaggtttgttacataggtatacacatgccatggtggtttgctgtaccaatccgtcatctatgttaggtatttcccctaatgctatcactcccctagccccacacaccccaaaaggccccagtgtgtgatgctccactgcatccatgtcttctggttgttcaactccgatttatgagtgagaacatgccgagtttgattttctgttcctatgttagtttgctgagaatgatgttttccagcttcatccacatccctgcaaaggacatgaaactcatccttttttgttgctgcatagtattccatggtgtatatgtgccaaattttctttatccagtctatcattgatgggcatttgggttggtttcaagtctttgctattgtgaatagtgctgaaataagcacagaataatttataatcctttgggtatatacccagtgatgggattgcttggtcaaatggtatttctggctctagatccttgagcaatcaccacactgtcttccacaatgtttgaactaatttacactcccaacagtgtaaaatcattcctatttctccatattctctccagcatctgttgtttcctgactttttgatgatcaccattctaactagcatgagatggtatctcattgtggttttgattttcatttctctaatgaccagtgatgatgaacttttttttcacatacttgttggccacataaatgtcttctttgagaagggtctgttcataccctttgcctactttttgatggggttattttcctgtaaatttgtttcttgtagattctggatattagccctttgtcagatagatagattgcaaaaattttctcccatcctataggctgcctgttcactctgatgatagttttcttttgctgtgcaggagctatttagtaagatctcatttgtcaattttggcttttcttgccattgcttttggtgtttcagtcatgaagtctttgcccatgcctatgtcctgaaaggtattgcctaggttttcttctagggtttttatggttttaggtattacatttaagtctttaatccatcttgagttaatttttgtataaggggtaaggaaggggtccagtttcagtcttctgcatatggctagccagttttcccatcatcatttattaaatagggaatgctttccccattgcttgtttttggcaggtttgtcaaagatcagatggttgtagatgtgtggtgttatttctgaggcctctgttctgttccattcgtctatgtatctgttctggtaccagtatcatgctgttttggttactgtagccttgtagtgtagtttcaagtaaggtagcatgatgcctccagctttgttatttttgcttaggatggttttggcaatgcaggctcttttttagttccacatgaaatttaaagtagtttttttctaattctgtgaagaaagtgaattgtagcttaatgaggtaacattgaatctataaattacttcgggcagtatggccattttcatgatattgattcttcctatccataagcatggaatgttttttcatttgtttgcgtcctctcttacttccttgagcagtggtttgtagttctccttgaagaggtccttcacatcccttataagttggattgctaggaattctattctccttgtagcaattgtaaatgggagttcactcatgatttggctgtttattatcggtgtataggaatgcttgttatttttccacatcgattttgtatcctgagactttgttgacactgcctatcagcttaaggagattttcggctgagatgatggggttttctaaatatacaatcatgtcatctgcaaacagagaatttgaataccctttctttctcctgcctgattgtgctggccagaacttccaatactatgttgaataggagtgatgagagagggaatttttgtcttgtgccagtttttaaagggagtgcttccagcttttgcccattcagtatgatattggctgtgggtatgtcataaatagctcttattttgagacacattccatcaatacctagtttattgaaaatttttagcatgaagggtagtgaattttatcaaaggccttttctgcatctattgagataatcatgtggtttttgtcattggttctgtttatgtgatggattacgtttgttggtttctgtatgttaaactaatcttgcatcccagggatgaagccaacttgatcatggtggataacctttttgatgtgctgctggattcggtttgccagtattttattgagcctttcacattgatgttcatcagggatattgacctgaaattttttttattgtgtctctgccaggttttggtatcaggatgatgttggcctcataaaatgagttagggaggagtccttatttttctattgtttggaatagtttcagaaggaatggtactagctcctctttgtacctctggtagaattcggctgtgaatctgtctggtcctgggctttttttggtttgtaggctattaattactgcctcaatttcagaacttgttattgttctattcagggatttgacttcttcctggtttaatcttggaagagtgtatatgtacaggaatttttccatttcttctagattttctagtttatttgcgtggagatgtttatagtattctctgatggtagtttgtatttctgtgggatcagtggtgatatcccctttatcattttttactgtgtctatttgattcttctctcttttcttcttttttagtctggctagccatctattttgttaatcttttcaaaaaaacagctcctgaattgagttttttttttttaagggtttttcgtgtctctatctccttcagttctgctcttagttatttgtcttctgatagcttttgaatttgtttgctcttgctgctctagttcatttaattgtgatgttaggatgtcgattatagatctttcccactttctcctgtgggcatttagtgctataaatttccctcttctaaacacttctttagctgtgtcccacagattctgctacattgtgtgtttgttctcattggtttcaaagaacttatttatttctgccttaatttcattatttacccagtagtcacccaggagcaggtttgttcagcttccatgtagttgtgcacttttgagtttcttaatcccgcattctaattagattgcactgtgatctgagaggctgttatgattttcattcttttgcatttgctgaggagtattttacttccaattatgtcgtcaattttagaataagtgcaatgtggtgctgagaagaatgtatattctgttgatttggggtggagagttctgtagatgtctattaggtctgcttggtccagagctgagctcaagtactgaatatcctttttaattttctgtctcgttgatctgtctaatattgacagtggggtgtgttcaagtctcccactattattgtgtgggagtctaatacccagtggtgcctggaacgccagcgagacagaaccgttcactcccctggaaagggggctgaaaccagggagccaagtggtcaagttcagcagatccaacgcccacggagcccagcaagctgagatccactggcttgtaattctcgctgccagcacagcagtctgaagtggacctgaggctccagcttggtggagggaggggcgtccgccattactgaggcttgagtaggcggttttccctcacagtgtaaacaaagtcgctgggaagttcaaactgggcagagcccactgtagctcagcaaagccactgtagccagactgcctctctagattcttcctctctgggcagggcatctctgaaagaaaggcagcagccccagtcagcggcttacagataaaactcccatctccctgagacagagcacgtgagggaaggggcagctgtgggtgcagcatcagcagactaaacgttcttgcctgccggctctgaagagagcagcagatctcccagcacagcactggagctctgctaagggacagattgccttctcaagtggggccctgacccccgtgcctcctgcctaggagatgcctcccagcaggggtcgacagacacatcatacaggagagctctggctggcaactggtgggtgcccctctgggacgaagcttccagaggatggaacaggcagcaatctttgctgttctgcagtctctgctggtgatacccaggcaaatagggtctagagtggacctccagtaaactccagcaaacctgcagcagaggggcctgtttgaaggaaaactaaaacagaaaggaatagcatcaacaaaaaggacatccactcagaaaccccatctgaaggtcaccaatgtcaaagatcaaaggtagataaatccacaaagatgaggaaaaaccagcacaaaaagggtgaaaattccaaaacccagaacacctcttctcctccaaaggatcacaactcctcaccaaacaagagaacaaaactggatggagaatgagtatgacgaattgacataagtaggcttcagaaggtgggtaataaactcctccaagctaaaggagcatgttctaacccaatggaaggaagctaagaaccttgaaaaaaggttagaggagttgctaactacaataaccagtttaggcaaaacaataaatgacctgatggaactgaaaaacacagcacaacaacttcatgaagcatacacaagtatcaatagctcaatcgatccagcagaagaaaagatatcagagattgaagatcaacttaatgaaataaagtgtgaagacaagattagagaaaaaagaatgaaaaggaatgaacaaagcctccacgaaatatgggactatgtgaaaagacaaaacctaagtttgattagtatacctgggaaaacattcttcaggatattatcccggcgaactttcccaaactagcaagacagcccaccattcaaatttaggaaatacagagaacatccacaaaaatactcctcaaaaagagcaaccccaagacacataattgtcagattcaccaaggttgaaatgaaggaaaaaatgttcaggacagtcaaagagaaaggtcggcttacccacaaagggaagcccatcagactaacagcagatctttctgcagaaaccctacaagccagaagagagtaggggccaatattcaacattcttaaaataatttttaactcagaatttcatagccagtcaaactaagcttcataagcgaaggagaaatagaatgctttaaagacgagcaaatgctgagagattttgtcaccaccaggcctgtcttacaagagctccttcaggaagcactaaatatggcaaggacaaaccagtaccagccactgcagaagcataccaaattgtaaacaccatcgacaccatgaagaaactgcatcaactaacaagcaaaataaccagctagcatcataatgacaggatcaaatttacacataacaatattaaccttaaatgtaaatgggctaaatgccccaattaaaagacacagactggcaaattggatgaagagtcaagaccaaatggtgtgctgtagtcaggagagcaatctcacgtgcaaagacacacataggctcaaaataaaaggatagaggaatatttaccaagcaaatggaaagcaaaaaaaataaaagcaggggttgcaattctattctctgataaaatagactttaaactaacaaagatttaaaaaaaacaaaaaaagacaaagaagggcattacataatggtaaagggatcaatgcaataagaagtcctaactatcctaaatatatatgcacccaatacaggagcacccagattcataaagcaagttcttagagacctacatagagacagactcccaaacaataatagtgggagactttaacaccccactgccaacattagatcaacgagacagaaaattaacaaggatgttcagtacttgaactcagctctggaccaagtggacctcacagacatctacagaactctccaccccaaatcaacagaatatacattcttctcagcaccacatcatacttattctaaaattgatcacataattagaagtaaaacactcctcagcaaatgcaaaagaatgaaaatcataacaaccaacctctcagaccacagtgcaaacaaattagaactcaggattaagaaactcactcaaaaccatacaactacatggaaactaacaatctgcttctgaataactactgggtaaataacagaattctgacagaaataaagaagttctttgaaaccaatgagaacaaagatacaatgtgccagaatctctgggacacagctaaagcagtgttgagagggaaatttacagcactaaatgcccacaggagaaagcgggaaagatctaaaatcaacaccctaacatcacaactgaaagaactagagaagccagagcaagcaaatcaaaagctagcagaagacaagaaataactaagatcagagcagaactgaaggagacggaaacatttaaaaaaaaaaaaaaaaaaaaaaaaaaacatcaacaaatccaggaggtgtttttttttgaagagattaacaaaatagactgctagatagactaataaagaaaaatagagaagaatcaaatagacacaataaaaaatgataaaggggatatcaccactgatcccacagaaatacaaactaccatcagagaatactacaaacacctctacgcaaataaacaggaaacctgtttaagcgataagatgctctttcaattggaagagtctatatatagaaaggctttacagatatgagattttattgggaaaacgagaccataagcagtggctggatcttcattaatcagcctgtatttcatattacattttgttgattttaaattgttgaagtttgagacagtaaaatggtgatcttataggatatacaatgtacctttctacatatacttcccacttaggagagcatatggagttaggtataccaggctcttttagctataaaatacactattcatgtacctgcctttttctgattacaggctcgtcaacctactttttaaaattgtttttattcatttaaattttttgtggatatatacataggtgtatatatttacctattttctgattatgatgtggatgcccatttaggcactcctattctgtaagttcaaaggagcactagaggtcaaaagccattttgtcacttaataagaaaaatatctatttttaaatcttctcttactgttttatgaaaggataggacacacacaagaataactagagcatacaccccaataatgggaactgaccatatgtgattcaataaaaaacaaacatattaacagccttatctttcaaattcatacagtatagctctttatcctcagaggttgaagtccgtattttcattatgtctgccctttctacctcactgaactaagagaaaacatacaaatgtgtactacgagtcaatagtaaagtaatcctcccctatactgcaaactaaggacgtaggattaatagtttctcccttagagctaaaaacaggggtaggagggatactatcgtgtatagaagcaataaaaaggggttacagtattcagtgttcagccatgcattatccaaaggagaagaaacatttcaagtcaacttaatctgatcccaacttcacaaactaacatttttgttgtaatttgctttcccaagtacatgtgcttatcaagagcaatatatttgtcaattgtatgtgaatattctgctgcttgttatatctcatttaagattactgaatttccatttttatttatatatcactttttaaacttaaagttaactcctcccaccccaatgtggatctgctagatgatctgaggcaatcaggcttctgcgtctgcaaaactgagtactagattctggttgataataaattcactggcaaaaggctgtcttctgggtcatttttgagttttcttgatgggacctaccatccatattgaaagatctcctgttttggaattgatgaaatcgatttaatattcccaaaagcatttaattatcagcttctattgtagaacagcttctacccaaatatcatcttcaatcccaccgatttcacttttccaactcctgattttagagtgtagtaaagccttgagaattgagaacagaggctaccatttcaaaattggcatggcaaaaagtgtacttcataggctagaagaagagtagaggtcacagtgttattatctctgtaatctctacgtctggaaggtatgactatgtagcaccagagataagagtcaaagttattgaagtgtaatgtaataaaaatataaatacacttctgcctatcaactaaagaagcagaaaatgagtaaccatccaacagaggatctccccagagtgaaaaattacaacagaagtagtggcaggaatagatttcctgatttaaatagtaaaccatgttgccttttatagagtatatgaatgaaattggcaagagtagctaattaattatagctgattactctatcaaatctcttggtagcataagcaaaacattaactttttataattatttggagtcaatgcactccaaatgcagtatgctccatccatagggcatacacattttaaaggcttttttcctaaaagtcttcactgcaattttagatactggtattttgagaactagaattaaataagacaattcataatatagtgcaagaaggctgaacattttaaatatatctacagtattggaaaacttaagatatgtagttttgtattttgtgtagaaatgacaagtctcagatgaaaacattaaactctaccatactaaaagcagtggtagtccagaaatttaccaaccttcaggatcgagtagtttctctatgcctaattgatatctggcgatgttgaatgcatgttccagtcgttgtgtggctgactgctggcaaaccacactattccagtcaaataggtctggcctaaaacacatacacatacacacatacacaaagacaaatataaatcaatctagaatgttccatgagatttacttccatgcttaattttcattgacaaccaatgcccatagtccttaagtcttgagtgtaattcatttaccctttaaaatatttctatttaaacaagtaataattttaatggaagatctcattgggtgtggtggctcatgcctgtaatctcaacaatttgggagacggaggtgggcagatcctttgagcccagaagttcaagaccagcctagacaatttggtgaaaccttgtttctaccaaaaaaaaaaaaaaaaaaaaaaaaaaagaaagaaagaaagaaagaaagaaaaactagctgggtgtggtgtcacatgcctacagttccaactactcagaaggctgaggtgggaggatcacctgagcccagggaggttgagggttcagtgaaccataatcgtgccactgtactctagcctgggcaacagagtgagaccctgtatcaaaaaagaatgctgaggatgtataccttaaatacatacaacgtttatttgtcaattatacagcaataaagatgtggggaaaaaagaaaatcctgaagatgacaaataatctacgctagcttatccaagcaacaaaaatttatctatctcatccagtctcgtggatttcaataccagccatttactggtaatgcccagttttatatgtctaacccagacctcttccctaaacttcaaattatagattcttctaaacactcattatctccatttagtaatcacaagcttcaagtgtcctgaactgagcttctgatgtttatcctcatcatactcccccaaacctacctacttttcttgctgttctcccttcctcaataatgaacaatgtgtttaaaattgcagttgctcagataaaaacccttggagtcatccttaatgactattttactctcacacaacatttaattcaaaatgtattcagaatttgactgcttctgactatcctcactgccatcactctagtccaaaatccattttatcttgcatgaattatcacaatagcctcataactcttctctcactcttgcctgcgttaattagtgcatagcagagttgccagagtgatctgttaacatgtttcatcatatccgtcttctcaaatctctgctttaggggaagtacaaattacgtatttcatgtgatctacgaagtccaacagggtccaggtccctattaactctctgattttatttcttgtctctttcctcatattccataaacaggatccatagtttcctgcacttggatttggaattcgcttttcgaagacataaacatggctcactcctttacttccattgggtctttactcgaaaatcacatcactgataagttcttccctgcccaagccctatctaaaattgcatgctggccaggcaccttggctcacacctgtaaaccaagcactttgggaggctgaggctgaaggatttgcttgaggccaggagttagagaccaacctgaaccacatagtgagacctggtctctacaacttattaaaaaaaaaaaaaaaaaatagccaagtgtgctggcatgcccctgtggtcccagctactcaggaggctgaggttggagaatcacttgagcctgggtggctatagtgagccatgattgtaccactgcactccagcctgggtgactgaggaagaaccagtctcctaaatagataaatgaaagaaaactgcatgcctcaaatcaaactcacatatacttattttctttctccttatctgctttatactattctcattaacacttactatttaacgtattatataatttaattaaatttctctgtgtatctttctcttccactagaatgtacaatcttttattgcctattttgttcactgctggaaacctagcctgacacaaaataaaggctcaacaaatatttatcaactacacgagagaatggatgagcacatgaaacttacataccatgttacttgataatagagaaaatgcaaaggagtgtaagaggcagttcttgtcttataaggattttaaatttaatgagcaagaaaaatgaagaagccatatgaattaattaaactctaaatgtgaaaaaacacagacaataagaaaatgttttgtaaaatctgaagcggtcaagaaagttttctgaggctgaaagacagattaaatagacgtttcgacttgcattaaaaaaaatgtattgataatagaattctaagttgtgtgagcgttagagaattaaagttcttagggaaggaaaaaagcaaaacatgctcagataatcaagacctcacaggcctggctccattggaagattctaagtatcaagtggtgggagataggtttaaaagaaagaaactggctgagtttgcataaggtgttggctgttaacgtattataatttatcccaacagcactggaagtcattagtcaagtggttcttcacctattctgaatcacagacacctttgagaatctgttgagagctatgaaacttctactcctacaaaaaaactctccatatctgtgaacagagtctacatacagttttagaatatttgaatctattaatggactcctgtttaagagctcatgctatgcaaaaacaaaaaaacaaaataacgaaaaaaacaaaaaaaaagttacaaaggtagtttagctgttatttttctaaaactgtaattcaaaattggccaggcgcagtggctcccgcctatactcccagcactttgggaggccgagacgggtcaatcacctgaggccaggatttcgagaccagcctggacaacatggtaaaaccccgacactactaaaaatacaaaaattagcagggcatggtggctcgtgcctatagtcccagctactcaggaggctgaggcagtagaatcgcttgaacctgggaagtggaggttgcagtgagccaaggttggcccactgcgctctagcctgtgcaacagagcgagactccgtctcaaaaaaatacataaataaaggtataggtttattggtttcttcttaattgcttctactctagttaatacaccagaatttttacaattattaggaaatcgaatccctccatattttccaatacccctaacagctaacaagcttatggaaactagcttatttacaaattggataatgcctttgttatgaaaaatatataaaaaaatttaaaaattgtagaatatttaggggacttttaagttcactatgcgcactctgccttatcttcatttttttctgtaggcaatgggagtaaaaaaaggacataggtgggaacatatgagaaactagttttctcatctatggcatagtatacaaggttaaattgagtatgatgagaaaaaagagcattgcttatgcattcgtgctgtattcccttgtcttaccttccccatttccttggccactaactaaccaactgagtgtgtggatatcttatctaagtcatataatttatttgagctttggcattctcattcaaaaagcattgaaccaaaaggcctttgaggtcacgtctagcattaaaaatgaattgaattcttttatactattaaaattaattaacattttaaatatctatgactttcaaatgcataaaaattgtaaaactaaccaactatgaaggaaacccacacagcatttaatgttaacctggaccataatttattgacttgcaaccaaggatcaccagatttttaattaaatcaacaccatgattaggatagtgtaaatttaaatcctagctctaccacatgttagccaaacagttttaggtaaattacgtaacctctctatgactcaatttatctatttgtgagatgggtaaaatgacagcatctacgtcatggaacttgattgaatattttacctagaacggtgtctacaaaataataattgtttaaaaacattcgtttctattattttgctgtaatgttaattacatttatataagaagagtgatgtattttcaatttacagactcaagccaaaaacacctatctttacagaactgatataaatgttacaaatactactgatgcaaacagaatgtaatccgaaatgggaggtggagaagaggcgagagtaagaatgtgtgatgattttctcgtttttcatattggtcaaaagttcctttctaaacttggtaaaaatttaaaatgaggtatactcataccatttaatgtaataaaagcaaaaattacaactataaaatgattataagtaataaaattaggaaatacctggggatgaaacataatatggctggttttcatactatggagtaaatacctatactgttagaaattagtttgtcaacaagtagaaacattatcacacatattattataaccagcaggaaccaaagtacaagtagctgacagtgactgcatctaagaattgaaataaggtaagttaagattggggtcatgaagacacattgtgtttctgttttccctttgctcctgattctagtgttcatttgcttctaatttgctgtggtaatacactaaaataaggatttaggaagacaattgtaactttatagttattgtaattttatctgcatcttttgtacatatttctaagcaattatcattgggttttaacacaaaaagtagaaatctggcttcctttgaagggtattgtagtggactttgcgttttatcacacaacttttaactgccatgacacttagtcaatccttatgctctatattaactacatgtctttgttctgtatagttgaaccactcaattattgaaatgagggcacctcatgacattcctaattgtgccaacgacaatcgctatggaacagagagttcaaccatttttttctttagataaagaatatgaacatctgccaaatacaaaaagaagggggagatgattcatgaaagaacattaaacaactgtgaagaacctcttgaaaagtaaccatgtaatacataaagagagttactgatgattcatccaatatgacaggagagagtatataaatgaggatattttgacagagaaagagtgggtcagggacagataaaacagggcaatttgggtatgtttactgtattacctacaaatgtattcagaaatcattaaatagaatattaacaaatatagagtgggaacatgcttgcaggattgaagtcttccacttgaagggaaaaacgttagagagccaacaaggaccacataacctgatccttgatatttttattcatctgcaaatgtgtacatgaacagcaaaatcaatattttcgggcccttagtgttaagcatgtggctgcataaatgagcattgacttaaaacacagacagaatgtctctatcccttctcatctaactgtattgaggctgtggaaacattttcttctgtcatacgagaaacaatgtgttaacgctgcttaacgtgacatttgaatgcatgtctgcctctgttctaaatcaggttgctgagtaattcacctggaaacccagtcgggatggggttaattaaatccagctggagcaagacacctgacaaagatgcttatttgaaatgtgtttgctcttggactgagctttaccttagagaaaattaatattcttagcttttctagaagcaggattggcataggaaaatggtagagtggtcaaaaaaaaaaaaaaatcaaagtgagaaaacataacttgcactgaaaattaggcaagatgcagtccagtgacattttaaacagttaattaggcaatgcatttagccctgggttgggtaaatgaaacgggtaacaggaagaccaaaataaagtgactgtagtccctctctctcaaatacacacacacaagcatatatatatatatatatatatatatacacacacacacacacatatatatacatatatagagtataaatggtgtagtatatatggcatatagtatatattgtatctctaagtgtatgtgtacatatacatatgtatttcctacactgctttgctttttcttgaactgttattaattcatttactgaactttacacaagaaaagcaaaaaaaatctttttcatcttaagaaatataatgttgaatggaatatagttaaggactttggttcactgtattacagtgaattctttttattaaaatccacaaaagatctctctcttgctttatagcaattgatttgctgttccagtgcaattgtttctgttggtattcaaaacattgtgtcatataattaattgtgttctgctctttgtcttggttactaaaaatgctctgagcatcttatgaccctgaactagaacaaagtatacagggctttatggtgtttgatatcaaagtgtgtatctgataagacagatgtttctttctccacactacgtatctgatgatggtaattaatttaactacaactactcacatgagatctagtatcatttttacctgtatagtttaggcttatacaaacacattatctgtataaaaagaccaacaccattctcggcaaagttagaatacaacctggatttactgggattcccagtgtcaaacatattgatactctccccctccactataaccactttcacgctccgctaatgttaatgtttcaacaactgaattatatgtatcccatagaacactggaaaatattcttaattagttcattccaatggaacgttagatcaatgtggtcaatgtacataacatgttgtaaagtaggacatgatctggaaccatactggggaaaaatatgtcatcagagtctaaatcaccacttttacaagttatttaatgtctcagtaatcttcttacctatgactatggatgagagcattcaaagccaggccatcagaccagctggtggtgaagttgattacattaacctgtggataattacgagttgattgtcggacccagctcaggagaatcttttcactgttggtttgttgcaatccagccatgatatttttcattacatttttgacctacatgtggaaataaattttcataagaaaatgcattccttgagcaagaaccatgcaaacttaaatatgaatgtccttgatcttcagtgataaatagaaattttagggccaattagtaatgagacataatagattctaccagaagttaagtctattctcaaaggctaggagtctattctgattcattggtatctatgccataccatttactgaatgtgttcactattactcctggattctgccatattagacccaacatttactgtttatagaattgctcaccttctagctttcaatgaacaagctagagaagacagtgtataaaacattagacttattgttaaccaaggacttaagatataaaagcgctttttggataggaggaatactatagataattgttttttaaagtatatgttcaaattttgcctttgctattaattgtggtaattggacaagttgcttaacctcttctaggcctcatttctgtgtatcttacatgcaaggttagtgtaagatcaaagtacaaaatatggtcagataaaacccctgatttcataccatcatttaacgcaagctatatttattggctgaactgaaaagaagacagaaatgtttgcctacctaaaataaagaaaaaaaacaacaaaggaaggaaatatttatccctaagaggtgtacatatgtagccttggttctattttcattacttggtttccatgtatttgattgtctcataggcttcgtgcatgtgcagatgttattcaacagattatcaagtttaattcttctgagtcatctgatgcagaaatccattctaagcattttttctaagtttcatgaatgcagtgacgcttcatagaaaaaactgtctacatcttttattaaagaattattatttattaaagactgctttttaaatataagccccttatgagatgctggaagaagacatctatgtaaaagtgatcagtctgtaccactaagcactttccttctgggaaggttaaggttcatatactatcaacatttgatcagatgatgaatatttattgtgcattctaaatatgacaattttattttttcatccatatagaagttaacaaatgcctttggggtaaatgcatattttaacatctccaatgttagtcatctttttattaaaaagtaaatgcaaattttaggatatactactaaatctcattttaacatacttttaaaagatttgagatgatgctttgtaaacacagtaacgattcggagatatgaaatctttgcatgtatctgtcacaatcccttgataactaagcctattatttaggagtggattatccaagttttcctaattccttcttgacctacttatttagtcagttactcagtgaatacaggtcaaataattacgtaatttgtctcatattctaaaattataaattgctcaacctttatgtacagtgactgcaggaggtgtattttgtgtcctgtgctaaattacggttggaatcagcagatagtggcttaatggtggtaatggatttgcaataatcaagcaatcctccaatgatgaatgtgattcatttgtgaaatgcttggccagtctgccctctatgtgcataacgttaaaggacaacaaagtattcaatccaaaactcctttatagcatcattatgtcactaattcagcttatcagcctcagcctcgctgttattgcttctacttaggtgcaaatgttgctcagacaaaaaaaaataataaagggcaatgtatgataatcatgtctccttttcctacataaaaggcagttatcaaaaaatcattgagctggtccccaaaggtgagcctgtaaacagaaaactgtcccgtcctcaggtctcactgtctctaaaggaggctcaatttaaacagatgtatttgtgtgtgtgcgcgcatacaactataaatcaatttttaaaaggaaaaaagttgaaatgtctttgagcagtgatttttaaaaatgactaggagttaactgggccaagaaggcatgatggacatggaggtgcaccaccaagattgaccttcaaggaagggcttgttgctccagctgtggtcaggcagcttctagttgttagttctctcaggtaccacctgagttgcagagtcctgccagccaatgtcacaccctctctagggcaacccactactattgactgatgaaggggcagagtataaacactcagccattttaaccccatttgagacaactctgaggggtcatcctagctgcaagttgtctatggggtttgaataagcgtgtcatagggtctacgtcacagctctagttcttcctctttccactcctgtcacctctgcccttctacaggtgtttttttttttttttttttttccagggcatggcttaataaacatgctgcctgccaaactcaactccgaagtctactccccagaacccagactgtgattaaaagaagttgcagcagaggaatagaaatgaagagggtaggaataatcttatatggtaaggatagtttctgtgaagctctgcagaagagcagagcaagaactgtcttgcacagaagtgacttggtaggcaggaatttacagggatggctttcagcagtgcgaacgtcatcattctcctgtaattgcaaattgtatcaataatatgaacattctaaagtgaattagcgttgccattaagtacatcccttgaattgtccagtaaaagtatggacctgacttctgatagctcaccactgttagcaagatttgttattacaaccagctggttgccagagccaagtttagcactccgaaaaaaaaagaattgcacttaagaaggaagaaaaagatgccaaacacatgttatatgctttgcaattttgttcaaacctgcctatgttacaaaatatgcgttactgttttaggctagcaattttatttgagatggacagtagaaaaacagtaataggaaaacagagtttgcattcctgagttttcacaagttcaatgagaagtcctccatggcactattaataacatagtatgttgcattagaaaaaggggccaacatggttctatctgtaaatgccgctcgttatctgatagatctagaatgtacattaagttgaccaaaatgtcctttaatctttgctgaaattcaagggcttctaccatttaataggaagaaaatatgtaatgttggtgtaaaaaaaaaaaaaaaaaagaaaaacacatttttagattcactggattatgatgaacactgagcaagataatttttcaaagtgtgcttaatagttttagaacagggcagtgtgatataagagagatgagataagtaagcagaggctgggaagagtctacagtcttgcagtctcaaggatatggtgattcaagggcataaatgaaaaacaacaggctataagagaggtctcagacaaagaaagatttaaaaagcattccttctgatattcctcattgcaaaagcgcctccacatgctaataatgaaaaatgggctgggtgcggtggctcacgcctgtaatccaaacactttgggaggccgagacgggcggatcacaaggtcaggagatcgagaccatcctggctaacacggtgaaaccccatctctactgaacaaaatacaaaaaattagccgggcgtggtggcgggcgcctgtagtcccagctacttgggaggctgaggcaagagaatggcatgaacccaggaggcggagcttgcagtgagcagagatcgcgccactgcactccagcctgggtgacagagcgagactctgtctcaaaaataaaaaataaaaaaataataataaatgaacaacttgcaagcaagtgaagaaattatcagacataatagtcttgaaagcttatcttggactagttcagatggagttggaaagggcttcaggatatttttaaaaatggtaagatcatataagaagtagtataaacaataaatacagttcagagtgccttttggagctctgtgcatgcttgagttcttctgctggctttgtcaaaacttacatctgtcttacgcaaagcgggatctgcaaactggattcactctaggaattatttgttactatgccataagataaagtcaacaattcagagtgcatcaagaaacttatgtagcgattttacagagtaccatttatgtctaatgtatttaataataaaggaggaagcatgggtgttgggcatcttatttttgtaacgctttggttttattctatcttacatacaatggattaggggaaaagtgttccttcctcaagatattttgagaagtactgagcaacatatgaaaagcagtttggggagagatgcggtatgttgcttgctggttctatttgacaccatcactatatggaacgggctgaaaatcggccaacttgggctcacttaaggctcctatgagctattctttgttgccagcacatattaattcccgctctttctcttcccctctccccgcttactgttgtgaagtagcattaagcctgttcagagaatttggaataaaaatatatgggggccaattaggagagcaacatggctgctgaatttaataggtactctttgtgtctactcactatttgactctgagcaagagcaatctacaattcaagttaaaattcaagccgggcgcagtggctcatgcctgcaatcccagcactttgggaggccgaggcaggaggatcacgaggtcaggagatcgagaccatcctggctaacacggtgaaaccccgtctctactaaaaatacaaaaaaaaattagccgggcgtggtgggggggcgcctgtagtcccagctactcgggaggctgaggcaggagaatggcgtgaatccgggaggcggagcttgcagtgagccgagatcgcgccactgcactccagcctgggcgacagagcaagactctgtctcaaaataaaaataaaaaaaaataaaaataaaaaataaaaaaattcaagtttaccgaatgaagccatgatatctgctacaatagggctggatctgaactattaccctcattgcaagaagccagacacaaaagaacatgtattatattgatataaaatatccaaaaaggcaaatacatatggacagaaatagattgacaattgcctagggctggggtgggagtgaaaaatgactgtaaatggagaagaaacttctttttaaggtggtggaaaagtgccaaaattagatcgctatgatggctatataactctgtaaatatcctgcaaattttaatgaacgtggtgggggggagttattcatccctcaaaatagtttgagaggctaccaagaaccagaactaaaccagattgatgcaaattgaattttacacttagaatgagtacattgatggtctaacaattacatttcaaaaacgctgatttataaaaaagtaatcccgaccagtaaaaacagcagtcatttctcagcctccaaattttttaaatgagtggaaaactttaagcaatcaatacaagtcatatgatacacctcaaataaaagtggtatactacactgagtgccttgcagatattctcccacttaatcgtgataagaaatacatacacatttatttttatttttactcttttgatagtgaagggaccatggcccagaacaggggtggcaatataccaaatgccactaagatggtaaccgtggaagtttaaattcaagttcatgttggtatatatatatacacatacatatttatacatatgtgtataacgagttactattacgtatatatatacaatgagtggaaaatattagtggatataagttcatgtatgattatgtatacatattatgattatactattatgtatatgtatacaatgagtggataatattagtggatataagttcatgttggtcttatatatacatatataatgtgtggatatgagtgtgtatatatatacatatataatgtgtggatatgagtgtgtgtatatacacacatgcatattgtatatatgtgtgtatatatagacacattatatatatacgcatatatactacacacacacacacacgggtgtgtgtctgtatcttttccacaaatccttcaacccattttgcagaggtcaaatagacagtcggaagaccctatgctcaggtgacttaaaaataatttccaaatcacattatggagtttgtatgtattacacacatttattgatagagatacccatattctactaatcttttattggcaataatttatgttaagaatacccaagactgagaaagcctcattcctttggtagtgattaaaataaaacatactaaattaacttatagacaagttatagaacatacatttgtgaaaaaaattactcacctatgattgggactttgtatttttaccttatacttactcaatgaaataaaattttgaaaaatattcctgtaaatgtaccagaacctattttataccgtgatgatccttaacatttcagacgacatggtagtgtcaatttaaaaagcagcactatggagcagggtttgttattgttagaaatacacatttgtttcacacgtcaagggtaaaaattaaaaaacaagattaatgttacccaaaaggaaaccattcatcaggattcttacctgccagtggaggattatattccaaatcaaaccaagagtcagtttatgatttccatctacgatgtcagtacttccaatattcactaaatcaacctgttaaagaaaggggtaaaacatttgaaggtaagagaccaaatgcctagttgcaataataataataataaaaacgtgaaggtaattgcatttagctattttcagagacttagcattgaagctttttgaaaataatctaaaaattaaacaaaatgcatgtgtaaaatcactttccataacaaacaagcaccccaaatatatttactttcagcacatgaatagattactgcagattaaagaggtcaactggagtatctccaaataaaatgtcataaagtatgtttaaaattaagatatgctttctagtatggaattacaactcagaaaaattcaccagtacttccacctagctccaaggagtgccattataattaaggctgactgcattttagtaaaacgcctctgttttagaatgaatgttaggtctctaataaacaatggagcaaactgccagctctcttatctctgtctaggactgtgtttggaaatgaaaatctggcagggttttatttgccttaatcaaggcaaatctctgtgtctcctgtccttcacactcctcaaatgtttaaggtggagtaaagttaaacacaagcatctgaaaagcaagcatatgaaaagatgttcaatgtttttagccaatagaggaatgcaaattgtaaccacaataatgtatcactgcacatttatcataatggttaaaattaaaaaatagtgccataaaatgctggtgagggtgtggagaaactggatgactcaacccctgctagtggaaactcaaatgatatagccactttggaaaacagtctggcagtttctcacaaaactgaacatgtacttattatacaatctggtaattgggctcttgagcatttatctcaaggaaatgaaaacacatgtgtacacaaaaacctgcacctaagtgttcatactacgtttatttgtaatagccccaaactgggaacccagatgccctcaggggtagataaacaaaccatagtacagccacaccatggaataacactcatcaatgaaaagaacaaactattgatacatgcagcaaattggatgaatttcatgggcattatgctaagtggggaaaaagtcattctgaaagggtagcatactgtatgaatccgtatctatgagagtcttgaaaagacaaagttacagaaatagagaacagaatagcagttggcagaggtcaggaatgggagtaagatgtggggtagctgaatgttcttataaaagggcaatatgagggacccttgtaatggtggaactgttctgcatattgactctgatggtggatttacaaacctacacacgtaataatgttgcatagaactaaatacacacatatgcatgcacacatacacataaatatgagtaaagctgggaaaatctgaatactattggtggttttatgaatgttgacatcttggtcatgatatcgtattttagttttataagatgttactacatcgaaggggagattgatcattcaagaataagaaagcatcatcatctgcatcatcatctggggattcctcatatggcagtagaggagagaaattcctccataaggaaaagccactatgaatttatctattgattcattgattcactaactcaacaagtaccttttggctatctgccaggcaatgaagtaataagagcatgtaaaagtaaaaaccttctgctttcatgaaacttaattctagtgatagtgacaatcagatgatatagcactaaagactcaagcagttaagcagagaatatgctatttttaggaaacatactcactcatactgcgggaagcactgctggtagatacgttttgggttgccatggacctgactctggggagacttagatcaagtaataggaacttagattccagtaaccccttatccactgtcataagacttgtcactgtgtaagcaggaagatagttcctccatttccttgtcctcataaaaggtctcataaggtccaatttccactatattcaggtactgggctcagacctgataaaggaaagtaaggtactacccccccagtgtcaaaaagttcacaacagaaggtcacataataaaaaagtatctaccattaggctctagcaattctacctctatgtttataaccaaaataattaaaaacagagattaagatattggtagaccaattatcatagtaacattattcacaatagccaaaatgtgagaacacccaaatgtccatctacagataaatggataaacaaaatgtggtatgtacatacaacggaatattttcagccttaaaaaggaatgaaattctgatacaaactacaacataaatgaaccttggaaacatatgctaagtgaaataagcaagacataaaatgacaaatattgtatgattctacttatatgaggtacctaaaatagccaaattcatagagaaaaaatggaagttattaaaggctaggggaggtgaaaatggagagtaatcgtttaatcagtatgaattcaacttgggatgatgaaatcattctagagatggatagcggtgatgactacccaacaacagaaatatacttaaagccactgaattatacactaaaaaaatagaaaaaatgatacctcaaaccctatctagggcaatgaacctgaatagacatttctcaaaagaagacaaaccaacggccagcacataaatgaaataatgttgaacatcactaatcatcagagaaatgcaaattaaaactacaatgaaatattacatcacacagaatggctattatcaaaaagacaaaaggtaagttgtggcaaagatgtggagaaaaaggaatctttgcacagtgttggtggaaatgtaaattattgtagtcatgaaaaacagtatggaggtttctcaaaaaattacaaataaaactaccatataattcaggaattctactgctgggtatatattccaaaggaaacaaatcaatatgtcaaagaaataactgcacttcaatgtatattgtagtgctactcaaaatagcgaagataggaaatcaacttaagtgtccatcagtagatgaaagaataaagaaaatgcaggtatacagacctacacacacacacactggaatactactcggacttaaaaagcagagaatcctctcatttgcaatgaaattaatgaatctagagtacgttacgtcaaatgacataagccaggcacagaaagacaaacattacatcatgtcacttgtatatgaaattttaaaatgttgagctcatagaattgagagtaaaatgttggttagcaggggatagagcttggaggaggagggttaggcagatgttggtcaaatgatactaaattacatttaataggaataaattcaagagatctactgtacaacatgctgactttggttaataacaatattgtattttgaaaattgctaagagaatagattttaagtgtcctcaaccccaaatgataaacatataagttaatgtatatgtttattagcttgaagcattccacaacatctagatattttaaaaaatcatatgctacatggtatatacaattttttttgctaattaaaaaataaaaaatagttatatggtaaattttacatcatttgtattttaccacaataaaaaataagtcattggaacacacatcgcaccccccccccacacacacacacacacagcagcagccacagataatacctaaataaatgttcatggtttttttccaataaaatttatctatatccacaggaaaaacaattaggtaggcaactgtgtctcacggaagcccaaggggtaagaaaaaggaagtaacattgtgaaaagataagcaaaagacataagatatattcatgtactcagtattgattaaatctgtaaagaaaaaatagattggaatgaagaaaagtatcaggtggagaaagcatgccagaaagcattcagatcactagggggtaattaactgattgggaattggagatattatattcagggacagaattgtattcagtggcagacagctactcttttttaacttttatattaggttcaggagtacatgtgcaggtttgttacataggtaaattgcgtgtcatgggggtttaatgtacacattatttcatcgcccaggtaataagtatggtgcctgataggtagtttttctgatcctctccctcctcccaccttttactcttgagtaggctccagtgtctgttgttccccactttatatccatgtgttcttgttattaactcccctttttttttttttttttgaggtggagtttcgctcttgttgcccagactggagtgcagtggcacgatctcggctcaccacaacctccgcctcccgagtttcaagcgattctcctgcctcagcctcccaagtagctgggattacaggcatgcgccaccacgcctggctaattttgtatttttagtagagacggggtttctccatgttggtcaggctggtctcgaactcccgacctcaggtgatcccgctcgcctcggcctcccaaagtactaggttacaggtataagccactgcgcccagcctaactcccacttataagtgagaacatgtgatatttggttttctgttcatgcactagtttgctaaggataacggctccagctgcatccatgttgctacaatcttatttttgtctgggttgtattccatggtgtatatgtagcatattttcttaatcagtctactgttgatggacatttatgttgattccccatctttgctactgtgaatagtgctgcaataaacatatatgtgcatgtgtctttatcgtagaacaatttatattcctttgggtatataccaaataatgaggttgctgggttgaatggtatttctgttttaacttctttgaggaatcaccacactgctttccacaatggcagaattgattaacattcccaccagcagtcaccacacctggccaatatcttatgcatacattttcagatactgatgcttctactgttattataacaattcacaggatgtatatactggatcagagtgtgtgtatacacacacacacacacacacactctgctctagtagatacatctatacatatatatatacgcatcatttcagggagatatagacatatctatacaagtatatgtgtatctacacatatacacatatatatctatacatctatacacatatatacatatgtatacatctatacacatatatacatatgtatacatctatatacatatatacatacacacacatatatacacatatatatgtaattttagtaggtgtttccacctgccttcctagaaacaatttagaattacatattttaaccagaatgtataagaataggctcttctctcaccaggaaatttttgttttgtttttgattcttttagttttgtttgtatgatcaaatacatcactttgttaacttttatttccatgattccttgtgcatttgaatatatttttgtatcactgacctattacaattccatgtgtgaattgtctgttaatatgttttgctcattaatttctatatggtagttttcttttccttcttgaattttaagagctcttggtaaataagagataacatttgtagaatgcttaccacttgcaaaatgtgattatatttcttataattcaacaaaattttgtatttcattcaaaagtaaaactgtcttacagatttatgatctttgctttttgactgttaagtacaaaggttaacctgacatcacaaaaggaattgtggagtttttttcttttcatatgctttggaatagcttaaagtatataaattattctttaagggttacgttaaattcatttgtaaagaatcctactacactcttcaacagtacacctttaataacctactaaatgttttctgaagtaatcagtctaattttccacttattcttatctcaattttagtgatttgtattgtacgagaaaatcaagttttccagaattttgcaaaattgttataaaattgcttttagtttccacttcatttcttctgtatctgctgtcatgcgtcttttctcatttatctcgtctagtttttattctaagttttctttgttatgactgggataggtttacctattttgttaatcttttcaagagctcacttttgaatggattattcttattcaattttctacgttgaatacaatttttatttttgtttctatttttacaatttcttaagatgcatacttcttttatttccatcttttaaaaatcttatggctatacagttctctctgaatacagatttcactatgcctacatcattagagtatgtatgagctatataaattttaccaagagttcatgaacattttacatttatgtgcattttaccaagagggaaacagagtatcaaagataaatgaagcttccacaaggtctgatttaaaactatgtctggatagaagatatttcattaattacatctagtgaattctccacaaaaagctttaagaggctctctctccaagttaataaacatttcacaccatgatacagacaaggattattatttattttggttgtgttttgtctcttgtacatgtcttcttcaaactaccaaggagtgtaagaaatgctaattgataaccatgaagactctagaggagggaggtatttgtcatgcctgaaagggtattgttcatggcatttatattactcttcaatgcctcacattgacggtctggtctgttttggccatgaattctcataagcttgttgctcttataatgctgtatttcttactattagctgtaagtcataacatttttctgaattcagtactatttcctcttaaataatcatcaccctgccatacagtaacttctcttttatgtttttttttctaatacacattccagaattatgtctttcaagaattatcagtctaattgctaaataactgaatggtaaaaatattaaaaccttttaaaatctgtgtgaagtgaatgattacatctgtctactaagcaaaacagaaaacattaatatgacatgtatgttaatgtacgagcctactgtgtgtatcagtgttgtgacaagcactctatggttggaaattaaatagtagggtcactgtggttacccaaagttctgctttcctgttttgcacaatgaaaacatctgataccaaaataggtgtgaaaattgatattctgtgtgaaaatgtaataacatgccttgagtttttgcagaaataagttaaactacgcagcacaattggcttttgtagttcctgtcaacaggcctaagattttactcataaagtaacatgggatgctgtctcagagttttacactgttatcttcggaagttgctttattcaaatgtaattttggaggatagaaaacctccatggtttgctttgacataatggaaacttattgtgactccagtagaatattaaaatgtgaactctttagaaacacctcaagttacaataagcagtctgtaagaattgcacatagaaaacctaatacattaaattattctttagtatggagtagtctcctgctgtctattttaaaggcataggacaagaacttaagggggtccctcttctatcgccagactagtacttacaatacataattttgtataacaatatatatttagtaattctaagattaatatataatcatttcagggagcatttacttccaggtactctacctcctaaatgactgggctatgaggaacaattctcgtcatttgcttgttcgagacaggcaaaaaacctcgctgttttcttttatcccactttccttcaggaacatggatgtaatttctaccatcgtcaatattttattcaagctaagattagatatcccatgatggtttacagtaaaaggatttatacttattatattgatatattcaagatttaagaatacttaagaaaaacttaagatgaaagtaaacctgaaatatgatggttttctgaaagattattgacaggaacaagttagtgttatttttgatttgctttacagaaagaagaatagcagactagggttcatcaaacagaaaatagtaaataagacgtcagaatgaggggcatgtaacttgaaaataatttcaataaccaagtcaaataatgaaaatggaagttcttagggcagagcagaaggagagagagaagggaaaatgatgaataaaactaagagttacattcctgtaagatatttacgtgtgtgtgtgtgtgtgtgtgtgtgtgtgtgtgtgtgtgtgtgtgtgtgatgtgtggtttgtgtatgagagagagaaaaagacaggtgacaaagttctgacaaagctttaatgaattttttcatacaattttatttttgttagatgcagagagagatggatgtttagagttttgtgtatcatttaagcatttgcggttttaacttggaagttgcagaaagttatatctcattcacaggggaaccatcatctttataatatatggtgtctgcctcttcttgcctttttagacaaccagtgacaaggacatttcagagctacaggctctaatgaaaacacgtcctgcgtcattcagccaattgaaattagactaaagcaggtcgtttctcacatttgtttcaaaggaattggttctcccagatcatttcagagtttgatatttgtcctaagaaggagtcacttttgttccctcatatgcagtgtaaaatacaagcatttttaaaattagctaagggagggggataagggtaagctaccttttcactcagtcttggtgattttaactagatatgaaatggtacaaactattataaaataatttcacaaaaagattctgaaaggaaccctgaaatatccttaaaagtttgagttgatttccttaaacagaatcttaaacaataactaaaagggaaatcccatgcattgaaaattattatgtaaatatccttcctgacactgaaacctcaagcatgtacttccaccatctatttggttctttcatttcttttcatttcatttcgttctcataaaatatatataaaccgagaagttccttccaacattctagataaacagaatttgctttttaaacatgttaaatgtcttttataagatgtctgccatcatgtagccaagctaaagacttctccatattcaagagaaacttctcaagtattcatacaatccttctaaatataatgcattttaaaaagataaaaaatacaggaaaggcaaagtagtttcattgccctgcagcatgtgcttttacaccacatttaagatttacactgtttaaaatttcaagacttatgggcataaatcatacctattttcttccattgagagatgcatgtattgaatctttttcttattaaatcataaatacgtcgatatatacaacctaaacggtgggccatattgccactgtggacctggatttccaatgacagctttttattcccttccttatctccgtatttcaagaattatttttgattcagatatagaaatttacattagataatttttgaagcacattttgacctcaactatattacaagatttaattctgggtactcactacaaagatactatctctaccttcaatgattaagttttacatatttagtcattctttaactatttttgaccactcactatatgccacgcatagaatgttaagaataaatttaaaaaatagactttcaacaaattgcttatggacaagtgaaatgttaaatttcctctatatttcagatatgtttatgatcactctgatacattgcaggagaattatttttaatggagtcatgttttcatttgtttatatactgcctctttgacaataaagaattgaggcagttaatacaagtgtctcataatcctaagaaaatatgaacatttaatggcatgaaagacattaaaacaaatttatcaaaatagaagttttgatacaggtaatctggttgaacgtattaataaaatgcaaactaaactttttgggaaagtagctcttttaactaaactcaacaaaattccttatatagaatatatattagagggcattgcctgagtaaatggacactgtcctcaatactttcacaatttagtatgaaagatatatatactttcagtatattatttaatttgaatttttgtaattacgtatcttttatctggcaatataggatgtaactttaacgacaaaaatcaacccatatagccccaactttttaagctcaagtcacgtatactaatttcaagtaaaaaaaaaaaaaaaaaagcaatagctacaataaaaatcttaaaagatacttgagtgacattataagaaatatttttaaacagtactatttatagttatataattattatcccagcagacctccatatgtgaacataataggtaactggctatctcaatttgaagttgaatatacaagaaatgtgtcaatactaatttcccttaaagcaagaggtatactaagggggatgggaagaataaacaactcacccagaaaattattttaaatgagaacatgctgcaatttaagagtagttatattaccttgcaactgaatgtgagtttaatgaatacgagattatgtttgtatatttgtatcttccataacaagtattttgaaagaagtgaacatttactattaatgcatttcgcagatgataaagtgagtcaaagtcacggaatcatttggcaaagaccctatagttgataagttacagagttaacaagatctacctcttctgcaaacttgagaattaatacatataaagtgcaaatattttacaggcctattgtgtggactgacaattttgtgtaagaaatacttgtctaacaaattaaatttggaatttgtacttaaatactagattttatgagtaataaatagaagtagtttatagtcaaatatattctgacatgctccaaaatatgtattatatggctatttaagtttctgaatacttaaaggacacataaaatactagttttaaagaacattttagaatcctctttatctaacattatatgccagcatgtgaacagtatatcatttttcagatcagtgacatctgacaaccattcaatctaattcagtgactattttcaatgatggggttaagtgaatatttgaacatagctgtcatctgaatttccaccctaggctttttaaatactcaccttggatttgtgatttaatgtatagcaatgactatttgctttgtagtatcccacattgtagatttgaagttacttggtaaaaacttaccaccttgtgatagacaattgatgagctggtacaatgaacataattattagatctacaactgtgtcagttaatattaaattatattaagtcagcgaagtcttggtaatgttcctagggtatatttcaacactataccttttgtatgaatctttataaaagggatcggaattcataaaatgtaagcaaggaaatcataagagggaagacgaggacacaagcttggagaaaggaagacagatcataatacatcttggggagcggggggtagtttaaagcaccacagttaaatctctatcaaatttgtaatttctaagttcctttaccagacaaaaaattaatcattaaactagacacaaaattattaaaagtgcaaatatctaatagagaatactcactgattagaacttagttatatccaaggaaagtttaaattacccattaaatatctttgagagaatagagttaagtgtagaactgaatttaaaatgcctaatgaaaggcactacttacaaacaaaagtgggacagggcaaagaaataatagaatggctgtataagagatgtttcatcctagctgggatttgctttaccttcaaaaacttgtaaataaaaagaagctgtggatacatttttacctagagctgatgtagagacaagaataaccacttagtagcatagtctcccatttctcaggattttgtattttgttcgctttttaaaatcacaaccaactattacaaatgagctttgctctcagcaaataccgcaataaagttatcactgcacttagaagtactttcttctcaataagtggctttccaaaatacattattgacagcagggataacttcatgctaaaacagccaccacaaagaatgcaaattggaacacagacgtagtgtctgagctctacagatataagctgagtggcattcaagtgaggataacaggttaaacgccaggacagggaaaggaaagaaactgaggaacagggttaaactgaggagctagtttagaactacagaatatgctagaactagtgatttatggcagagggacaggctaaaatggaggagaccctaaggaaaagagagaagacaaaatgaccttgacttaatgatccagaaattaccaaaaagtatcattttgaaaagacacttctaatattcctttaaaaatcagagggctaaattttgagtgatttttttaaaccagggtttcttttcataggtttatagaattaggaggctgttcatatgattttctattagcaattatcaatttcttggtgtgtggacaaacttatcactggtattcaaaaaaaaatttttttttttggagacaagtcttgctcgatcccccagactagagtgcagtggtatgatcacctctcagtgcaacctccgcctcatgggttcaagtgattctcatgcctcagcctccccagtagctggaattacaggcgccagccaccacacccgtctaatttttttttttttagtagagacggggttttgccatgttggccaggatggtctcgaactcctgacctcaggtgatctgcccgccccagcctcccaaagtgctgggattacaggtgtgagccaccacgctcggcctcaacttcattttttataataaacatatatgtatttctgtgtaaaacccgtttttggtttctatatctcatacttaatatttcccttccatttttaaactgcatacatttgtttttctccctccttgtctggatcacattcataagatattaatctatttcatattataaggaactagctgtatattttatctagtgtttcttctatttctttatctttagttcctgctttccttaaagcatttttgtaacatttttatttgaaagcttgattcaatttatctttttaatgaagatcaaaatcaaagacaaaaattcaaactctcagtacagcctgagccatttctcatgggttttcatatggaatgctttttccttcacaaatgtagttttatactcttggtttaacaaaccttaatcaaacttaatttataagtatattattagtttctactgttattaaataacatgaattttgaaagtttgtgtgtatttaatgacattttcactgcattcaaatatattgcccgtttataatttgtgtatgtggcaggaaattttttttactattttcctaagcctttaacaagtttacgacgaagagcagatatccgaagtgactctcagcgtgtctttcttttctggctctggttgtctccagaagaataggaaggagtccttagtccccaaattagccagaaaccacgtctactctctgtcatcaaatagaagtggtatggcctcaaaggtgactggcttcctgatgcatccaacaagactgggccctagccaacatcagagttctcggcatgcagattctcaagtcctcatttcgcacagaaacaaaacagaactagatacctggaatgccgattataccgttttccactcctacttcactaacccaccaaacttcttcacctcttctttgtatgtgatgactacatcacctggaatctcttaaccttggacttctggttagactaaactaaggagcggcactggcaaaacactggaggattctatggagagactaaggtatcacttctctcaacttcaccaggcaatgatttgaaactaacagcattctttagatacctaggggctcagttcacagttgtgtccagtggcgctctcccaacatgagggattttatcaaattaatagccctctccccttgactgcttaggtttagatgtagtaaaggttattaactcatgtgaatccctgcattcttcaccatagtttcttcctttaatcctccccacgtttctataaatattcccctgattacactctcttcaactttttctgtatgccacgtgtttaatatcaggacagttaatacacttgacttcacaagataccttaaaattgtatagtgaatgtatcacttggttgcctcaatgaactgaaaatgaaaatgcttttgccctatgaaagacaccatgtggatctactgagctctggccattccataggctcaggggagagcattcccaataatgacagacatacgattttctgaatgccttgttgagagttcagacttgaatttagttaatgtaactgaaatttttaaactattgctcttcttgcacatccaacttcatagggagatttattgataatgctcatattttatagaagtatctactatgctttagtgttgagatacagaaaatcactattaaacctacagttatttgtactctcaatcttttgctgttaaatatgtcataaacttgacagtggtgaattaatggctctaaaaatatatttccatcaatttttcttcatggatttagcagcatttctactgtgcgatacgttttcgttattgactgtaactttcttgaataaaatgacactctaagtttgttagtattctatcactgatttttcattttgtctgatttttcctgttttatattttttattattctttaagttctggggtacatgtgcaggtttgttacatagttatacacctgcgatagtggtttgctgtacccatagacccgtcacctacattaggtatttctcctaattctatccctcccctagccccccaccctctgacaggccatggtgtgtgacgttcccctcctaatgtccatatgttctcattgttcagctaccacttatgagtcagaacatgcggtgtttggttttctgttcttgtgttagtttgctgagaatgatggtttccagcttcatccatgtccctgcaaaggacatgaactcattctttttttatggctgcatagtattccatggtgtatatgtaccacattttcttaatccagtctatcactgatggacatttggccaacatacatacgaaaaaatgcttatcacttgtcattagaaaaatgcaaatcaaaaccacaatgagataccatttaacaacagttagaatggcaatcattaaaaagtcagcaaaagatgctggagagaatatggagaaataggaatgcttttacactgttggtgggaatgtaaattagttcaaccattgtggaagacagtgtggtgattcctcaaggatctggaactagaaataccatttgacccagcaatcctgttactgggtatatatccaaaggattataaatcattctactatgaagacacatgcacacatctgttcattgtggcactattcacaatagcaaagacttggaactattactgatttttaaaataacctgacttatgacccatttaatttctagtagtgtttttttagtcattgtcatctcatttagacctgagtccaaatgccaacaatggctcaccatgctttcttcttctcacccccaccttactacctctctgctcccctatctctgctatgtttcctttatctctaaactcactctactccacttgctgaggcctcattccaaatgctttttcaccttaaggtctttattaccgtgcctaacccaccttcctatagacaattccaaggctcactccctttctccaggtctctgctcatataggaactgaaccaaaaggtcttctcagacctcttattctatgtatctcttttttattcacttaactgttcctaagtatatatgcttcatattgcctaccatgtggctgtaatctctgacacacaaagggttgtgtttgctctgacaccaatcaatcaacttatatacctgtgaattttaaaaggaaatttggataggacttcttcaatgtgattatttatatcctgcacaggcttattgatatagaacacacccaagctcaactttagaaaaaaaatcctgcttgagcattttgatttattcttcctaataagcaaactaaagttgtacttatggatgttttccatttttgtttatacttatgacaaaatggagaattataagataatgcattttttttttttcactctgtggccaggctggagtgcagtggcacgatctccactcactgcaacctctgctcccaggttcacgtgattctcctgcctcagcctcatgagtagctgggactacagatgcacaccaccacgctcagctaatttttgtgtttttagtagagatggggtttcaccatgttggccaggatggtctcaatttcttgacatcatgatccacccgcctggaccacccaaagtgctggtattacaggcatgagccaccgcgcccagcctagatttacttttgaaaatccatgtgttattgttcagccacaggctaaggtaaaggttcctttgttccaagtttggtttctgcatgagaatgtcttgaggttttgtcctctaacgcataggccagcatcttatgcagctccccattaaagctctagctcagatgaaagcattgttaatatctgcttttgaacaactccttctcaaatttaagccattattttggggccttttccctactaaaacattaggaggttctatattttctgtaagaaatgtggccttccctgaagagattcatatgacatcatattctaattttatattcacttatattcatttaataatttcattagaaaacatggggtctatgatcagatttctatatatggcccgtggagtttcggaggttttaagttcccttcataagttcctcttttaattgaagtggaatatgcatatagaaaaatatacataagtgtacaacttgatgcgttttcttacagtaaatacacatgtgtaacagctatcaggtcaaaacatggaacagtgagcaccgcagaagattctcttatgcgttttactgacttactccttccaaaagttaaccactctcttcaattttaaacccatggaaacattttgcccgtttttgaaatttaattgaaagaaatcatagtaggtataatttgtctgatttatttcactcaaatacattttaacgacttcatcttgtatattgtgtgtagctatcatttggtcattttcattgctctgtaatatcccatcatgagaatgtatcatagtcacttccagtttgggctatcacaaatgaaactgctatgaacattctcacatatatatgtgtttttggcaaactgggaaatgtatttctgtaacttgtatgtctacaatagaattgctgggtggtaagaaatgtgcattttcacatttagtagatcatgcccaactctttaattagttgcctgaattatatttccagaagttaattgtgagatttccagttgatccatgtcctcatcaacatttggcattagtagtctagttcagtcattttggtaattttgtactggtatctcattacagctctaatttaaatttcctcaagttactgctgaggttaaacatttcttaaatatgattcttgaatttgtgaacaccttttgtgttcctgttcaatttcagtttctcattctagaaaacctaaaatttaaaaaaaaaatcaagaaaaacagaagactgggatactccatatgtaaatgtgtcagttattctctatagatttaactcaatgttaatcatacttaaaatgaatgtacatgtaaatggaaaagattacaaaacaaatacaaaaatagaaagggccaataaccaataaaatctcgaacaaagtgggagaacctagttcaccagatactaggctgtattataaaactacattactccacattacatgatatttgtgtgtgtagagagagagagaacaatgcaagagaattgaagtgcaaaaacagacccacatatgtacggacaaatttttaatgacacacttagtactgtgaagcaatgaggaagcattatttttaataaatggtgtgttaattagacttcaaataaaataaatactgagtcttaacctattcctcacaccatatgcaataatcaatttcaggtaaaacagatccaaaaacaaaatggtaaaacgataatggttctatagataataacctaatatagtatcataatggctttgggtaggccagtatttcttcaacaggtcataaaaatataaagttttaaagaataaactatatccaagtggagaacttgtttttattaatattaaccattgaagtgagtaaaaaggtaatccacagaaaaggaaaatacatttgcaactcaaaacaaagggctcatatccagaatatagcaataactcaattttgatgaagtccaagttaacttttctctttttgaaacatgctttggattcaggtatcataaatacttgcctatcccaaagtcatataaatttccttctatatgttttattgccaggatttttctggttcccttggagtaggcagatagccagaaatgagcaggcaagggagccccattgagaaaagaagtcctgaagatgctgtttcactgagtcagtgctgcctgttgacaatcagcgaaacggacaatgaatacacacactgtccacactgattatgtctagccttgtggttgggctcctctagccccaaaggggacttctcaggccctcgccagagataaccacgctagggattttccccactgacaagcatgcacacactcctccaaaaacttgccctattcttttgctcattgtaatagtgtaaacaaacaaacaaacaaaaaaacccacacacccctgggtggagattttagatgccaatgagatgtggtatgtgtgctagcatgtacaaccagagcatgtgtgcccaaaaaacctcccaaaacatacttgcaagtaagaccccccccatacaccctttcatgatttatcacgtaggagtctcaaagttccccagcactagctgctgctggctctttgttcccttgtgttcgtgtgcattcagtgtttagctcgtacttattgagaatatgtgttattcggttttctgtttctgtgttagtttacttaggataatgacctccagactcatccatgttgctgcaaaggacatgatctaattcttttctgtggctgcatagtattgtatttcatgctgtatatgtaccaaattattattatttttttttttgatatggaatctcgctctgcctcccaggctggagtgcagtggcacgatctccactcactgcaacctcagcctctgggttcaagcaattctcctacctcagcctcccgagtagctgggattacaggcatgcaccagcatactcagctaatttttgtattttttagtagagacggggtttcgccatggtggccaggctggtctcgaactcctgacctctggtgatctgccagcctcggcctcccacagtgctgggattacaggcatgagcaccgcgcccgacctgtaccgcattttctttatgcaggattgagttttacaggatatcccaaagtttgtttttttaaatgacattttcttgctggggacagtcaagctacaaataaattaaatctaataattctgtgttccgctcttttcttcactgctacattttgaaacagaatatgatattttgatatttcaaagacattttctttgtgtaactttaatattgttaacaattctcataatgtcaatgacactgatatttccaaagagtccatcggactaataaacaagaaaatcagctcatagattattctggctgcggagtgaaaaatctagttaatttcttcctaagacaaacatctctgtaaaataactttcataggttaaaggtgacaatgaccctgaattcataaaatcagccaattaattgctgcacagtttccatttccatatcttatgtaatgtcatctccctgccagataagctgagcaacatttgggggagtacatgttattattaatctatccctgcttatggttattttaagagtaagtgatcaacgtactcaatgtacttgagtttatctttgaaagagagaggtaatgtaattagggagctactaagtgcctggtgaaatgtattggtcgattagacagattttaggatgttaataagaaaggaaggctgcctccaatgccatgacacaggggaagagtcaccaagtggttcagaggagattagaattcctctgacctgcctacttggtttagctgtgactgtttacttcttctaatgcaacacacgtattttaatccagttaaatctaaaccaaaaaaacaaatctgccattcataccccaagtaaaaatagtgatgtttctgtataatttatatgcttggagacagcgtttaataagtgttggcttgatttaaacaaacatcattatcaggtttgaacacatttagtacataaatatttggtatagaaaaatccgtttgttgcacaaaacactgccgtaagaaacagagttcaccgggcacggtggctcacgcctgtaatctcagcacttcgggaggctgaggcaggtggatcacctgaggtcaggagttcgagactagccttggccaacatggtgaaaccctgtctctactaaaaatacaaaaattagctggccatagtggcatgtgcctgtaatcccagctactcgggaggctgagacaggagaatagcttaaacctggaaggcagagtttgcagtgagccgagatcacgccactgcactccagcctgggacagaagagcgagactccatctcaaaaaaaaaaaaaaagaaaagaaaagaaaagaaaagaaaaaagaaaaagaaaagcaaagtaagaaaagaaaccgagttgactgcaggactttgtccaccaaacacagcttcatgaagtaaaatctgaaaacagggagcagcctatcaggtcaggtctatgtcttttcccttccctctgtggcagcatgcatttgcttcctgaattatattagccacaatcaggcatacacgaattacaacatgtgctctcagtaagaactggtctgatttacaagagaatttgaaatactttctctgcatttggggccaaagccctcactcaaacatgaagcatgctgtgtcacagcatccagaccttgtccagggtactacttacattattgttctgcaaaacccgcagtgccttgttgacattgttcagggcatgaactcttgtggatcctttttcttttggctgagaacaaaacaaaagagtgttcactgaccagcagagagaccgacaatctactagaaatgaaaccatttataatttcactattaagcttgaatattgtaaacgaacagagcctgtgaggcattaatataatgaatctaaatactttgcgctaattgtccttggcctggtacgtttttagcataaaccaaccactctaagaatggcaacactttttctttacaaagcctattttggtatgattgtttcttcattctatagcccagttggggattactgcatgaccaccaatgacagaaacatcagcatgcataaaaacattttctagtaagatagaaaaacaattcccaaactttttagaaaaatctaaaggagatttgactctagcaaaattatataatgccaaatagggttaaaggaaaccttttctgtgaagattaccttaattgtccttgtcactgaagctctaaacctcaatcactttggttccctaattttattctcaatcccaaaagttgtatcttatcctgtaatttttaaaccaacatctgcatagttcattgtaatatacaaattaactcatttattaagttgtagagttttagaaattctaccattatgataacctgttttatttactctcattttcatttcttttaccttactacaagcccttattagctattgcccagagaaatctaacctctttcccttctccactcactcaccatttttttcatccttccttcataccatcaacaatgacgttcctgaagtaagcccactgccaatgcaaaccacttgcaaagttctcacctaaacatttgggtgattataggtaacagttaagggcaagagctacaaagctgactgcctgggttcaattgtcagctctgctgtttttgtgctgtctggcctacataaaaaatttaatctccctgtataccagttttctcatctgttaaaaatggacttaatgaaaatattagcaagaggcatacacaagttacaacatgtgctctcaataacaactgctctgatttacaagagaattcgacatactttcttctctgcatttgaggtcaaagccctcactcaaacatgaagcatgctgtctcacaggatccagaccttgtccagggcactacttattgttcatattgctcaaaccattgtacatatggtttctggcagaattcagtgtgtcgatatgcataaagcactaagattggtgcttgtcacatagttggtccaacataaatattattgacttcgtagtatgtgccaagtactttgaatgcactacctttaatccccgccttgcaaggcagttagtttcatccctattgtacagaagtgaacctcaggttaaaatatctaatatatagattaccatataactaataattggtggagccaggacccaaacttttgtctgtgtctgtagagccccagtcttgcaaatttatttccttcttctctaactaccttgtgcatgcaccaaacaaatatctatatttctgtgtcttgcatttaactcctatactttccagcaaagctcctggtctttctcaagtagttcctcaccctagaactccttatcatttgcactgcctgctgaacaacccaaattaagctaaagccatcttactctccaaggtaacttgcctgatatcctttataacacagtattgacatcttgttcctttgatttcacaaaacattaaggctaaccttatgaaccagaatctccatttttacctcttagattttcctccaagaatgtcagaatgatgttggtttacattctgatatttctcccactttccaccaaaaagaggaaaaaaataagactttagatttaaaaaaaaaaaaaaaaaaaaaaaagcaacagccagacatttggggaggctgaggcaggtggctcattgagatcaggagctcaagaccagcctggccaacatggtgaaaccccatgtctactaaaaatacaaaacttagccaggcatgatggaacatgcctgtagtctcagctacttgggaggccgaggcaggaaaattgcttgaacccaggaggcagaggttgcagtgagccaagatcatgtcgctgactccagcctgggcgacagagtaagattccatcaaaataaaaaaaaaatacatgaaagaaaaacagcaaataaccaatcttcttgtgtatatatagattgacagtatacaagtttaatggtaattataggactttaaagttttgaaaataattactcaaatcagttctctgcctagtagttagaccaaagccacatatttcctttcaattatgtaattatatagtcacaagatttagcaaaattttcctttgtatcatattcaaacattaaatgtacacatgtgcatatgtattagaaccaaacatagtctactcttttaaaaagctgcagtttctgatcctgaagtgggaacttaaaatctgcccctattagagtctccttggggagtatttcttattttatgattgtaaggcaagtaccttccttttaaccctggggatgtcctgagccaataatccaaatgcagatgcttctgagtagaatactaaaatttctgttctatagtatacatgcctcccattaggagtagaagatatatctctacagaaactattagaattcaagacaaggcatagcgaattggagttctgggatcgggagcatttgttagaggtgattctgctttatgagaaaggcaaaatcctcagaccagggctgacagatctgtgattaggacaaacaatggtgaatggattctgttagtagcagtatctgaaattatgtaatctacactgccatgtgtaaatgtttggtgatttttccctaccactagcttaccttatactggccaatctcatggatattttgtttgatatttttttctttaatgctattactaattaggttcattttgtcttagcgtctatgtatgtatatgcataaatgcaaatcatgtggattttttaattttgccgaaattagtggttttttctttatatcaaatgggtagtgtgccaacatcataagtttagagaaaggcttatctcatatctgagtataaacacccaaatcatgcttatgaattacgaaaggatctgaaattcattatcttaaacattatgtatgaaatttgttaaccctgactaaattgctttgggtgatagatggattgactcagtcagggaaatgaccagaggattgcaacacaggagaagtgatcacgcagatacctggaagtgaagagacaacagcctcctaacagagggccaggacaagatgagtaagccataatctttgaaagatttttcacgaacatttggaagacactgggacttctgtattcggtaacaaagtaggactgacttcagaatacaggagaaacgagatacacagacacactgatttctgtacatatgctacgtatccatatatatgtaaattgttcacagtcataggagatgaattacacacaaatctatctctaactagtgaaattaagaccaagtttacatgatgacctcaaattggcgcccagcaaacagttcagctataaggtattaaatctgattttcccccttgactaaagttattatttcaatatgtcatcaagttgttcttctattagtacaagttcagacttcttgaaaaaaatggatccgttttagtattaatctcacatagctgaagataaaaaatgaaagcataggtatgtctcttctgtataggacttcagaatttaattgaggagggatgtcagtcatacatacactaaaaacaagacaaaaatgggccttctgtggaatttgggagggaaaaattagcaaaggtaatttgggaaaagctttactgaggtgaaatcaaggtttctggcagacagttggggtagacagaagtacaaaaagaaatacaggcaagtaaaataatacaggcaaaaacccagagatatctgacaatatataccgagaaaagagtggcttagcgttaagtgttacaggaggcaggctggggtagataggatttttgctaactgactttgaacgacagcttcagtttgtataatatgacaaaatctgtgtgtgtctgtgtgtgtatgtgcatgtgctggggagttgtaatgaagggcaaagataagagacgaaggctatgatttagcagaatttgataggtagaacagttatttatgactatagactgggggcttaaactctactttttagaatagcaatctaagacgattatttcagtcaggggatttcaatttgagttctttccccccccagtgtaagaccttgatcaacatgacttcactgatctgtaatcatgtatatcaatcatgtatcttcacaggaatgctctgaagttagacaagataatagttcaagaggaagtgatattttcatcacatatgctatcacgtattacactataatgcctgtaccttattttgctatcccacatgtataaactcatacaggttccttgtaaaataacttcaaaaatacacaaaagtacaaagataatttctcaagtcattatgtataaaagccttcattaagatatttgataagatagataccaagtagtaaaactgaataatatctattaatataaattgtattactgaaatttttactttttctgcaggcggtagagtatgccaaatgaaaatcatacgaggttgctttactaaggaataggtattgctgtttcaatcagtacctagtcattctactagatgtcataaaactatgttgtcagtttctggtctgaaattctactaagtttaaagttaactttcttaaaaataagtcacataccagtttttgccctgtcaggccttcgaggaggtctaggaggcgcctcccatcctgtaggtcactgaagaggttctcaatatgctgcttcccaaactgaaattaaaaaaaatacactcaatttaacaaagcacacttccaatgatacattttcacgattatccccttttgaaaactaaagctatatttaaggataattagtgtgcataattaatctgccgaagatgacggatgaaaaaaggaaagttcaaatgacaaaaaaaatttaaaaattttatcataggtcaagtctatttgaattagtttgaatagcaagagtaagagatttataccctaaatgatctaattaattcactgaaatgaatatagattctatgaaggagagaaaaaatacaggcatgatcaaggcagttacgggtaaagggaaaagtaaatacacaaagaagcaaaagaccacaatctacctgggtgggtacataaagtttaaccattcttggaatataccagtcagagtggttcgacatccttatcactcaaaacatgcttgctgtgcatacacattttgcatgctatgacctattctcatactggataactcaaattttaggaatatcgggtttaattaggtttgaaacaaccctgtgagagcttttcatctattttactcagttctttgctcaggaattatactaaggaaaaataatagtcaataaataatatttaacatttttaacgtaaatactcatgagacacactattaaatgagtggatttcataaccgttgtggcatttctgagattagcagtaacatacttaacctctaagtatctcatgtaagatgagtatgtggctctttgtcatgaaactagaatggggtaaagccaaaattatggctcagatctgtctaattctgggttcttgttctttcaatcttatgttgcttccttgtccttttataacctactatttgattatctttctaacatttgtctttcttttgtcatacttcaccaaatcgttttctgcttaaaaccctacaatcccctcatgaggtaattcccagctttttcatcacctatctggaaatccctaatttaatcagtcaaagacatattgagcatgaataaacctgagctaggtactgaatcatatgctagtacatcagacataggcccagaccctatagaacttagagtccagcaaagaaaatattcctaaaaggtactattacatagaagcattagaaaggactaaagaacatgtaacagtgggagctctcacaagccttgggatcaacaaatactttccaaaaaacgtcaggtgatgggtctaacattagcctttgggtgactgtgctctttacatacactccttggatcacatataaactttgaatttcacacaagtcaagaaaatccctggtttccaggcaaaagacatcccttaaacttccacgattaaaaacataggatttagactattcctacaaccaggtagccatgtcaatgacaagacctgtaaatgcccgggtacttcaagcagggaacaatgatacctgcggcaaccaaccagtccctgtgtgcccagctttgtgaatccagccacatatatacttagacaaaaattatgagttattcttttgaaattctactcaaatagatccattttcaaattccatgggaaaaagaacataacacaaaaccctaacatgctagaatttttaaagaatagctttactaggagggaggcagaacaagacggtcaaatacatggaaccttccagcaatcatctttcccgctaccgctgctatagaaacaccaaactgaacagatagccacacaagcaagcacctacataaaaaccaaaaatcaagtgagcaatcacagtacttgattttaatatcatatcaaggaaagaggcactgaagatggtaggaaagacagttacgaattgccaacaccacccctcccccatcccctggcagaggccatgtctcatgtagacgatctgtgtgcttgcaggagggagggcgcaggattgtgaaacgttgcattggaacccagtgctgccctgtcacagtgggaagcaacacagggcagaattcatcaagcgcacatagagggcacatttagaccagccctatccagggaggtatcacccatctcagcagttagaagctgagttccagctagtctcaccagtgtgagctcaagcactttggggtcctaaataaacttcaaagggagtctaggctacaaaaactgcaattcctgggcaagtcttggtgtcgtgctggactcgaagtcaggggacttggtgggcacacaacccagtaagacaccagtgcttgtaccaccccatcctctaacccctaacagtgcagctgacagctttgagagagactgcttcttccacttgaggagaggatagggacagtaaagatgacattgtcttgcaacttggacacaagctcaaccacagtaggataaggcatcaggcagagtcctgagaccccccattccaggccctggctcctgagtgacattcttaaatacacccagggccagaagggaacttgctaccttgaagagaagaatccagtcctggtagaattcgtcacctgctgactaaagagtccctgggtcctgaataagcagcagtagtagccaggcagtattcaccaagtcttgggtaagactcagagccatgctgtctttgggtgtggcccaatgcattcccaagtgtggtggccatggggatatactccttgtgcttttggaaaggagaggcaatagagtggactttgtcttgcagcttgggtactagctcaaccacagtcaggtagaccatcaagcaagctcctgggttctctgattgcaggccttggctcctggatggcatttctggactcacctggggcctgaggagaacccactgcacagaacggagagacccaggcctcgcagcgtttactcctagttaactaaaaagctcttgggccttgagtgaacatcagtggtagccaggcagtactcaccatgagcctgaggcagtggtagccatggggaaaaattcctctgcttatgaaatgggaaaggaagaatgggacaaactttgtattgtggcttgggtgccagctctgccacaatagaagagagcaccagatagattcataaagatgcaacttcaggccttggctcctagatggcaagcatcaaaagtcaaggataaagacaggatcctaaaagcagcaagagaaaagatacattccaaaaagcttaacaacaactagtaacaggcttctcagcagaaaacttacaggctaagacatgtcatgccatatttaaagtgctgaaggaaaagaccctttatgctaggatagtgcatccagtgaaaatctccttccaacaagaaagataaagaccttccaagacagaagctgtgggatttcatcaacaccagacctgttctacaagaaatgctaaagagaatttatcaactggaaagaagaggaccttaactagccagaaaaaccatctgaaggcacaaaactcagtaagtacagacaaacacaaactattgtaatactgtaattgtgatgtatgaactactcatatcttgaataagaagagtaaaaaaaggaagctttcagttaacaaataactctaataactttaagacatagacagtataatgagatataaacaaacaacaaaaagattaaaagagacgaagtttgagtttttaattagttttctctttgctttcttgtttatgcaaccagtgttgtctgtttgaaataatgggttatagtgtttgtaaacctcatggtagcctcaaataagaagatatactaagattcacaaaatttaaaaagcaagaaataaaagcatgccactagagaaaaatcgccttcactaaaaaggaagacaggatggaagagaaagccacaaaacaaccagaaaacaaaatggtaggaataagttcttaataataaaactgaacataaatgaaataaactctccaatcaaaacacagtgacagaaaaaaaaaaaaaaaaacaaacaacaacaacaacaacaaacaccaagactcaatctgttgcctacaagaaacacgcttcacctacaaagccagacttaaaattaagggatgtaaaaagatattccatgtcgatagcaaccaaaaaagaacaggagtagctattcttacatcaaacaaaatatatttcaagacaaactgtaagaagagacaaagatcaacatataataaaggaatcatttcagcaataagatataccaattgtaaatatatacgtaccgaacaccggagcacccagatatataaagcaacattattagacctaaagagagctggaaacctcaataccccactttcagccttggacgtcatcaggcaaaaagtcaactaggaaacattgaacttaatctgtactacagactaaatgtacctaataaatatttacagaacatttcaaccaacagctgcagagtgtacattcctctcatcaccacatggaggattctcaaggatgggccatatgttaggccacaaaacaagccttaaattcaaaaaattgaaatataaagtatcttatctgaccacagttgaatgaactgagaaatcagtaatgaggaattttgaaaattatacaaaacacaagggaattaatctatattctcttgaatgatcagtgggtcaatgaagaaattcataaggaagttataaaatttcttgaaacaaaactgtaaacacagcatactaaaacttgtgggctacagataaatcagtactagcaaagtttacagcaataagcacttgtatcaaaaaaaaaaaaaaaagagaaacaatacatcttaaagaactagaatagcaaaccaaactcaaaattagattgtgtcatgaagacatgcaaaacccgaacagaccaacaacaagtaatgagatcaaagatgtaaaaagtctcccagtgaagaaaagcccgagacctgatggcttcactgctgaatgttaccaaacattgaaacacctaatactcaaactattgtgaaaaagaggaggaggaagtacttctgaactcattctgtgaggccaatattagcctgacacgaaaaccagacagatatccagaaaacaaaactgcaggctattatctctgacaaatactgatacaaaaatcctcaacaaaatactagcaaaccaaattcaacacaacattaaaaaggtcattcgttataaccaagtggtatttgtcctagggatgccaagatgggtcaccatatgcaaaaaatcaatgtgatagatcgtatgaacagaatgaaggacaaaaaccatatcatttcaatagatgctgaaaaagcatttgataaaaattcaacatgccttcatgataaaaactctcaaaactgggtatagaagcagcataccttaacacagtaaaagccacatatgagaaacccacagctaatttcatactgaatggggaaaaactacaagacttttctctaagatctgtaacaaggatgcccactttcactactgttgtttaacatattactacaagtcctagctagatcaaagaaagaaacaaagggcatccagattgaaaaggaagaatcaaatgatccttgtttacaaaactaggaatcccattacctgacttcaaattatactacagagctatactaaccaaaaatgcatgctaatggcataaaaacagacacatagaccaatggaacagaatagagcccagacacaactccacagacctaaagtaaactcatttttaacaaaggtgccaagaacatacactgaagaaaagaccatcttttcaataaatggtgctgagaaaactggatatggatatgcaaaagaatgaaattagacccttatctctcgccatatacaaaagtatcaatctaagtggaacaaagacttaaatctaaggcctcaaactatgaaactactacaagaaatcattgggataaaatctccaagacactggtctaggcaaatatttcttgagcaataccctaccaagcacaagcaatcaaagcaaacatgcacaaatgagacatcaagttaaaaagcttctacacagcaaggaatacaatcaacaaagtgaagacacaacacacagagtaggagagaatactggccaactacccacctgacaaggaataaccaaaatctataaggggctcaaacaactccatagaaaaaaatatatataatcatctgattgaaagaagggcaaaaatttgaatagagatttctcaagagatgacacaaatgtcaaagaggaatatgaaaaggttgtcactatcattgatcagagaaatgtaaatcaaaactacaatgaggtatcatctcaccccagttaaaatggcttatatccaacagacaggcaacatcaatgctgatgcggctgtgtggaaaagggaaccttggtacatcgttgttggggatgtaaagtagtagaaccactgtgaagaactgtttgaggttcttcaaaaaaactgaaaacagaactaccatataatccagcaatcctactgccgggtatatacccaaaagaaaggaaatcagtttgtcaaagaaatatctgcaccctcatgtttattgcaaccctattcacaatagccaagatttggaagcaatccaagtatccattaacaaatgaatggataaagaaaatgtggtacatatatacgtagtggagtactactcagtcataaaaaaaaatgagacgctgtcatttgcaacaacgtggatggaactggaatacattgtattaagtgaaataagccaggcacaaaaacaaactttgcatgggctcactcatatgcagtaactaaaaattaaagcaattgaactcatggagacagagagtagaatgatgtttaccagagtgtagtatgggtagttggggacaggaggagtgggaatgtttagtgggtacaaaaatctagttagaatgagtaagatctatttggcaacacaagagggtgattacagtcaacaatttactgtacatttaagaatttgggccaggcacggtggctcacgcctgtaatcccaacactttgggaggccgaggcaggcggatcatgaggtcaggagatcgagaccatcctggctaacacagtgaaaccccgtctctactaaaaatacaaaaaattaggtgggcttggtggcgggcacctgcagtcccagctacttgggaggctgaggcaggagaacggcgtgaacccgggaggcggagcttgcaatgagcccagatagcatcactgcactccaccctgggtgacagagcaagactgcgtctcaaaaaaaaaaaaaaatttgaagtggaatgtttgtggcacaaagaaaggatacattcttgaggtgacagatacttcacttaccctgatatgattatgcttcgcatgcctgtatcaatatatctatttaccccctaaatatactatgtatccataaatttaatctaaaacaaagcaactttactatacataatatacacataaatcttaaaacagtgccattttaatgaaactttaaggaaagctctctagtaataagaaaataaatttacactttctaatagtgctgccaagaacttcatatctaacctggaataatttggtattttgagtgtaataatttgtttttcaaattgaatgaaggtatacaatgccattaaaatgatgtgtttttttccctcctttggccaggagcaaaatttcacacttatctgagcaaagcatgacttttaaactcatcaaaaaataatcttatgcactgcaatgtgtccattgttgaagaaaatatagttaactgttaactgacagagatacttgtttttatgaaaagaaaaaatccagggtagaaagttgaagtctgtcagaccaagaagtatgtgcgtgataaactgctgtttattcaaaaagaggagcagagactgggaaaggtgagagaagtcttggagtacagaataaaacatgaatcccaaagccatcaggatcatatagcatccaagacacaaggactacgtttgggtttggagacaaagtctaggcaaaggtcaaaaacgcagacagaatcttgctttgtgggccaaacttaaatacatagaccaaggtcttttataagtcttcttttaaaactggaggtaaccaaaatggagagggagtaaaggattataggtcaggtaggggattccatgtacacctagctggggcaccgagagagagaaagcagtgaggtgatagagaaacagttcctgctatcgtattattttcgaaactcacagagtcaatgatatattaaagtatcacaattgaaatccaatttctattagtcatattcaccatattctctaatagagtgcttctcagaatattctaccagagcatccttccaggaaatgaaattgaaggaatttaccctggagtctggcagtataaattacacagtgcctgcaggttttaaatttctttgaaagcatatactttatgctaaaaattcctagagattttgccttcttcttttaatatatgcttgtttcaacgtaaaactatttatttatcatttattttttgagacagagtctcgctctgttgccaggctggagtgcagtggcgcaatcttggctcactgcaacctccgcctcccaggttcaagtgattctcctgcctcagcctcccaagtagctgggactacaggcatgtgtcatcacgtccagctcagttttgtatttttagtagagacggggtttcactatgttggtcaggcttgtctccatctcttgaccttgtgatccgcctccctcagcttcccaaagtactgggattacaggcatgagccatcacacctggacttatgtaaaagtaattttaagtacttttgagtaaaaatctcccccacccccgttcccacggtctgatgtggttttttttttagtgaaatgtgctacatttagcctgtaactttatagacctttcggtgctcagttttattctccctgtagtatgaataccccaggtaaaatctaacatactatttctcttggatggttctaattttcctgcctgcaacttactctatagaattatagatactatagcaaaagtaacccaagtttcagaagcagaaatagctaacttctgaactcaggtctctcactcactcactagctgtgttatcttgggcaagtgacagcctttctgaggcacaatttattcactattagaatggggctcaaattattactccagagcactcccgtgaggttcaactgcaacacataggaacgttatacagatttggcaaatcgtatgcactcaataaatatagattgatttttatgtttcattttaacactatttgtctgcatctctttctttgaccaaattctaggtgtaaaaacgtttaactcggccaggtgcagtggctcacacctgtaatcctagcactttgggacgctgaggcaggtggctcacttaaggtcaggagttcgagaccagcctggccaacatggtcaaaccatgtctctactaaaaatacaagaattagctgggcgtggtggcacacacctgtgatcccaactactcgagaggctgaggcaggagaatcgctagaactaggaaggtggaggttgcagtgagccgagatcgtgccactgcactccggcctttgtgacgaagcaagatctcacacacacacacacacacacacacacacacacacacacacacacacacaagttaaagtcttttcgataatataaaaatattatattagaaagtgcagaatacatgtaaaatgttttctattagtttggcatccctgtgggagtgcaagtcaataggggaaggcattattccctatacaattactaaaactggtgaatgcagatggtacagaggatgcacttagaaacttgctttttcctcccttttcttgttcttttgactatttttaagtattcttttgttgttctcccctttcatcttcaacatacaccatgtctttgttgcaggtggcattttatatcctaagaacaatattttttctttaaaattcaacctttaatggcttccttttcaagtgtatgagaactattttgtgaagcacacaaaacatgaattcctccttgggccaggcgaccctgtagctctctgtcttcagttcattttatgactaagatttcccttatcaagtgaactgagtggatatctgatattactcagtttaatgtatctgcatatatattgtctttgttaacccaaaccacaacacgaaaggacctaaaaacgagacagtattccttccaaatcctttttagtatgaaataaagaaatacggaagcacaaacagtgttcaaaaagaaacacagataggtaggttgacaagtggcataaataaagtgaaccaaatcaaagtggaacaaatcaaagtaaaaaaatttgagaaaggaaatgcatttgtgaaggtgtttaagtggtttctgattcttcagagttgtattggtcttttaacctgaaaatccaaagggatcaatacgtttcagtagaaagtaaagaacacagggataatttagcatgaccttctgattacaaaaaggacaagccatggacataactgtcgctaagaaagtcaagatacttctgcaattacaaatccctagacattggaaacaccaaaaatatcgcaaataccacaaagaattgcaaaactggggattcaaaacttactgaagaacgctgctgaccagctcccagaaaaataaggcaacccattttcatgtaaataggaagctttccgagttgattttttttttgttttcttaaatatgagttggaaaaggtattgtataataaagcagtattctgttgcggaataatatacatagaggaaagtacacgtcttaagtgtacagctcaatgaattgtcacaaaccgaacatatttatattaccagcatcgagatttaagaaacagaatatgatcaacaccctagcagcttcctcacaccccctatgtggaagctcccctcaagaatggccactatgacgacttgtggcatcataggttagttttctcttgaaaggagtcacctaaagatagaaaaatgctggttttgtattttgagttagaatactagtgactgaaatacattagatttatgcagagggaatttagaaaaaagtcacactgataaaatatgctttggaaaacacgggggaatggtatgatgccatgaataagaatgttgactgtacacccagaatgccttgggttcaactcccagctctgcagtgtgatcttgggcaagtaacttctccgtgccttactcttttcatctatagaaagagcatgtatcattacctatgttgtggtgatattgcaaagatttaagtgaacttagtatggcactttgtaagatatattctgtaagtgttagctatcacacgtttattccaaactttctaagccaaataatccatatcgtctataactttccttgtaatgttggcctcaaagtaacagaagggaccaacttcaaaatatgagaattaaaagggttaataaatgtaagatgtctggtatggtacctagcatagaaaatgctcaataaaaacattaaataaattacattccctcctgttaaatgttatcacctggaggtggagaatgacactctcctttgaaatttatatggccatagcaggactttggtaatctgagaagagtttaataagggactgtttataaaaatgagggaaggtataatgaaaccactggaactagtaatagagaagtgtcactactactcttagactcctaagaatgaaaagaaggagagtggtttctagttactacatagagagagaactgagaagagaagattatctgacaggagctttgatattgggtgatggaatttctttcctctctccctctcttaccaaggctctcattggccaaatccaactagtagccagagggcaaaggagcctgttgatgtagtccacagacatcagcctcccaaggaagacaaaagtggagagtagggccaaagaaataagccaaagacattcaccaccctagacatggaagcaaatttcctttgagccaaggagatcaatgccagggatgtccatatcagaaaataaatgaaggcctacgtgttacttcccatgcctcatatttctatctctggtgatgtcattgtaaggaatcatatgtatcactggaacaccgtcgtcttctttaatagtgatatcaaaatactggaatgttttgtggaccttagcagataaaatcagtaggtatttattcattattccttagcgtcaaatacttgtagagacttctctctaccaaaaaaagcacgaaaatctggctatgaagatcatcaagaaaaagccaagttattccttgcagctagcaagtgttcaagagcaaagctacaaaatacaagtttttataatctctccagatataaaatgttatttggcattttataaagcatcttaactagaacccaatatgtatgttactctattaagtacactagaaatgattcaaacagatgtgcattcgaactttaaataggaaaccacaccatcgttaatggaaatcaagttgttatatgtaagtgggatgttatgaacccagaagtatgcttaacaaaaagtcagcatgattcattgtctgatcaggtctatccttaacatgttttgtaataaaactaacttctaaagctaggtctcaattgttttatctttaagttaggtcagtactcattcattttaccaggtattctaaaggaaatattaataaaattatggtaaatgctttatcttatatttttatgtattaatgtaattcacaaagttattttaaaatttgtggaatgattacaatccatgattatactaattacaccacctttaaatatcccctataaaattgaacattctgaaagttaaacccagttttttgttgttgttgagactctgtcaccttggctggagtgtagtggcgtgatcttggctcactgcaacctccgcctcccaggttcaagcgattctcctgcctccgcgtccctagtagctgggattacaggcgcgagccactacgcttggctaatttttttatatttttagtagagacggggtttcaccttgttagccaggctggtctcgacctcctgacctcgtgatccacctgcctcagcctcccaaagtgctgagatttacaggcatgagccactgcaccaggcctaaatccagtttttcttttgattcacatagatacatgatttgcatttgagatagccagtgatggaaatgaaggctaattacaatctatcccaatggttgcttttctgacagaaacggtatggtacaaggttggcaagatgaagcactttgtttcaaagcatgcaaataacactgattcttcaaaaaagaaatctataggctaggcgcagtggctcatgcctgtaaccccagtactttgggaggccgagaagggcagatcacttgaagccaggagtttgagaccagcctggccaacgtggcgaaactccacctttactaaaaatacaaaagttagctgggcatggtggcacgcgcctgaagtcccagctacttgggaggctaaggtgggagagaatctgggaggcagaggttgcagtgagccaagattgcaccactgcactccagcctgggtggcagagtgagactccgtctcaaaaaaaaaaaaaaaagattgtgtttatacacacacacacacacacacacacacacacacacacaaatacacacatataccatgacataatggaatggctcactagacaaacatctatgagtactcagttccagggaaattgcagagaagaaaagtgatatttaggcttcagatctagtagaggaaacattatggacaaagggcatccaaagatgactttaattaatgaatgtaaaacgtatttattaccattcttataatttctcaattaccctacggtgcagttgtgtatggacaatataggtgacaagacacagcttcttcctaattattcccatcctccacctactgggaagtcatccttggtttattcattctttcttcttccatgcctgtaagggtctgtctacaggaagttccaaatcaaagaaattggaaacacagaaaagataaatgtcacataggatacaatatttaaagaagatcttctgtcaaaagtcacagaggataaaatatttaaaggagaacgtctgtcactgctatgctttatttccttttagtggtccaactttatgcaatttccaattctgaagtcaaatattgtcaaatattacaatttttatatgactctacctcatgtatcagaaagatgcgagttacacacatcgactggtttatgtcagcgctacttctgtgtactttttgtgggttgttttaatgttcacagtcacccccattttacaactgatgaaacagacacaatataagtaacttgaataaggtcacacagcaagtaagtgctagatactaatttggacttaggcagtgtatctacagatctctacaccattctttactttgcaactgctgtttaagctgggcttgactatcatcacattcaggggcaagggttaggtgagttttacttgagcctttacgtcatcttttctacaaagatagtttaatatatcttttctttcttctatcatttccaaaaggtcagatacagttatatagcctgccaataaaattgctcctaattgtaggtcccatttgtaatggaaagatagtaacagtgataattctacatatatacattaggaaaattcttcaaagtcccaaattcctattgttatatcatttgacatcgggggtttcattaactcctcaggactccagtgtgctcagcagactcaattactaaatactattttagagcacactgcaaattgttcgaatgtataattcactctaatgtatttgaaaaatgtggctttttatattaactaaagaagaaatatcattcaacaaaaacttaaggctatataaatcaaaatataagaaatataatccttgaagttgataaggattaaatgaggtagtagtaaacagaagaaaaagtttaactagggcatttagtgtagccatttcttaagatccactgaaaagtgccagttccttacttgaaagtcttccatgtgagattcggtgtagttgtaagttaaataatatagtatctggaagcaaataggcctttatttattacagttctataatttaaattttgccagttgtgtgaacactgataaattacatagcacttggcttattttccttatgtgtcagacgagggggatagtcattcaactaaatgtaaccagtattatgcatcatactgtcctaagaaaaatgggaagataaaagataaaaacatactgccactgttttcacagcttttgtaatagcctaggaaggaaatatacatttaagcgaatataattatagcatggtgttataatcctattaatagtgatttttttgtcgtaagtatggtgctggcacaaataaaagatatcttcactggagagaacaacagagtgaaaatccctgaatagaatatacaaggttgaacaggttatcaacaggtagaagtgtaaagggaagataaagtcaagcagaggaaacttcacatgctaaggatcagatgaaatagacgcactgttcaaggaactataagccacttcttggaacgtaagtggacggatggaacatgagactagagaggtacaagacaccccatccgagtgtaccgacttgattaaccacccaaagctgcttaggcaaatgtctgcttgtcttttcttttcaccctttcaaacataactaattttgagaagctcttaccatgttttgcattttttaattcatattttgactgacactttaacatagtattgtttaggaaaaaccaatattggcactgtttaccaattatttgcatgcaaaaatatttggcaaggaagccatactgtccaggagcaactgctgtaaatggtaagttaactacaaaattgggcctagtatttcatcctttcctgaatccataccctttgcaatgtagcattgctgttcttctcatgaaaagttggtatctatttccctgcttcttaaatctgggttggcatttgactcattttgaccaacagagtgcaattgaagtgctggcatttcctctcccaaatgtagacctcaaaagggcttgaacacttttgctctcttgttcatgcctctgcatttaccgtaagagcacatcagagctagacagcaggaggatgagacaagtggaaccgagtcaagttgccctagttgtcccagatgaagttttcccagactagcagacagccagacatttcgcagagctgagctgagatcagcaaagccccttagccaacccccagctaactagagacacacgagtaatcctagcagtaaggtgaagaacttcctggctaacatatgtatttgaaatagtatgttggttgttttaacctactgagtttcaaggtggcttattacacagcaatagctaatatgtgtacatacatatgaatatttgtttctacacagaagatgtctgaaaaattaagccacattataaagatatttataaaatatttttaaaagagccctaggagtttttatgagaaatatcaagctagaaattattttactgctgaaattgaatatgggcaaaagtcagtttctagagatctgactcatgtgctattagaaaagaacacagtcattatattccatgcagttcctccaatgcaatcttgcaaaaaagaattaacgaagcaatagttttgtcagtttcatagaaattttttaaatacagtgtcaaccttaatatatacatacacacacttttttttgggggggggtgggggggtggggggggggggacagagtttcactctttcgcccagcctgcagcgcagtggtgtggtctcagctcactgcaacctccgtctcccagtgtcaagcgattctcctgcctcagccttccaagtagctgggattacaggcgcatgccaccacgcccagctgatttttgtatttttttagtagaaacagggtttcaccacattggccaggccagtctcaaactcctgacctcgtgatccgcccacctcggcctcccaaagtgctgggattataggcctgaaccaccgtacccggccaactttcaaatatttctaaagctacctttcgtaagacttagtgtttaactcttctgttgtagccactgtattgtaaatgcaactaaggttgtattccttgcccaatatgttcatttgacgttcaattggagaagttaaaaaaaaaaaaaagttgactttatttttctcccatttgctagatttttactgtcactttagataaaaagtgtgtttatcttgttttcttcattataagctataatttccagtggtttattcagacatttccaaaacaaaaatagtaaatcaaaaatagttccctgtgaactaaaactgtcacctttagttagtgtttctagaaaaatgcattttaaaataaagttgaataagagccaaaggaaagtagagttgacaatttttttcttacaaagctcaaagaaaaaatttaaaattgccctatgagaaaatcttaataggtacctgacatttcaataggaaaaattagttataactgcttaaatagaagtttttaccaagagctttattacataactacaaaaggtacctaattcagtgattcatctttatcagcaaacatttgctaattgtaaacaatcctgtacaaaatatttttatttcaaagaggtagcaactttccaaaaatattgaaccaaaaggaaattgaaatgaccttggtttaaaatatcattatcagcttgaaaagtggaaactatcaaatagttaaccaactttttaaaagattggtgctcactcacctggctgaatgacctacctctttgaaccttaaatttaaataatggctcggtccacattaaccttctcttgattttagactgtaatatccaatatgggaatttaagcaaaaacttaaagttacatcaaaaatggaaaaatatggagagaggccaagatgaccaactaggaacagctgcagtcagaggctcccactgagaagaaccaaaaccgtgagtgaatcctgcaccagcaacagaggtgtccaggttctctcactgggactgactaggcagttggcatgagagcgcaaggaaaagcagggtggtgccatggcccacctgggagccaaacgcgacaagggaagctcccactcccagccaagggaggtagtgagtgattgtcctaccctgcctgggaaatctttctttttccacagatctgtgcaacccgcagatcaggagatcccacttgcgagcccatgccaacagggccttgggtctcaaaacacagctgtgcagattctcgcaggccactcggatggagacgactccttaagactgctcagtttccgggggcgggggcggccatcatcactgcagctgcctgttacagcaaatgactgagctctcccggggaggggcggcatctaagagaactgccacctaagagaactgagctgctgtggggaggggcagcagccatcacggtggctaccggcttactgagaggactgagctcctgtagggagggcagcagccatcactgcagctccagtccaccatttttccccttcaggtttgagggagactggacagtttgaacccaggaggaattccctgcagtacagcacaccagctatggcaaataatggccagattgcctcattaggccggactctgacccatccctcctcactgggcagggcctgcttgcaggaattccagtaactccagccaggggtttagggaaagaactccgattcccctggacctgagcccctagggggaggggtggccatggtctccgcagatcagcggacttagtctttaccctgctggctctaaagaatccgggaagcccagacaagtgggattcccccaggacagcaaaccccctcgaccaaggggcagccagagtgcttccttaagtgggtcctggatcccgtgcaccctgactgggtgagacccacccccaacagcagtcgctagacaccttatacaggaaggttcctgctggcatctggtcagtgaccctcagggacagagatactagaggaaggagcaggcagccatctttgctgttctgcagcctccttaggtgacatttccaagtgcagaagggacccaggtgaatggggtctggagcgaacccccaacaaactgcagcagccctatagaagagggacctgttaaaaaagcaaacagaaagcaacaacaacagcatcaacaaaaaaaatcccaattaaaaccccatccaaaggtcagcagcctccaagattgaaactagacaaactcatgaagatgagaatcaaaaaacaaaaacactgaaaactcaaaaagccagagtgcctcttctcctgcaagtgattgcaactcctctccagcaagggcacagaagtggacagaggctgagacggctgaattgacagaagtaggcttcagaagatgagtaataacgaactttactgagctaaaggagcatggtctaacccaatgcaaagaagttaagagccatgataaaacattacaggagctgttaacaagaattatcagtctagagagtaacataaatgacccaagggagctgaaaaaacacaagaacttcacaatgctaccgcaagtatcaataaccaaatagaccaagcagaagaatgaatttcagagcttgaagattatcttgctgaaataacaccagcagacaagattagagaaaaaagaatgcaaaggaatgaatagacgcagaaaagtcttgataaaattcaacatcctttcatgttaaaaaccttcagtagattaggtattgatggaacatgtctctaaataagagctatttatgacaaacctacagccaatatcatactagatgggcaaaaactggctgtaggttttggtatgacaaacccttgaaaaccagcacaagacaaggatgccctctcttaccattcctattcaacactgtattggaatttctggccagggcaatcaggcaagagaaagaaatcaaggataaataggaagagaggaagtcaaactgtctcttctgtgtatctagaaaactccatcgtctcaccccaaaatctccttaagctggcaagcaaattcagcaaagtctcaggatacaaaaatcaatgtgtaaaaatcacaagcattcctacaacaatagacagagagccaaatcatgtatgaactcccatttacaatggctacaaagagaataaagtaagtaggaatacagctaacaggctaagtgcaccacctcttcaaggagagctacaaaccactgctcaaggaactaagaggacacaaacaaatggaagaacattccatgctcatggatagaatcaatactgtgaaaatggccatactgtataatttatagattcaatgctattcccatttatctaccattgacattattcacagaattagaaaaaaagaaaactgttttaaaattcatacagaaccaaaaaggagcccatatagccaagacaatcctaagcaaaaataacaaagctagaagcctaatgctacctgacttcagactatactacccaaaacatcatggtactggtagaaaaacagacacatagaccaatggaacagaaccaacatcttggaaataagatcacacatctaatacccaaccaactgatgtttgacaaacctgacaaaaacaagcaatggggaaaggattccctatttaataaatggtgctgggaagactggctagccatattcagaaaactgaaactggacaccttccttacaccttatacaaaaattaactcaagatggattaaagacttaaacacaaaacccactaactataaaaaccctgtaagaaaatctaagcaataccattcaggatatatgcacaggcaaagattttgatttcctgacaaaaacatcagtcaattgcaacaaaactaaaaattaacaactgagatagaactaaaaggcttctgtacagcaaaaaaaaaaaaaaaaaaaaaaaaaaaaaaccacaaaacccatcatcagaatgaacaggcaaactacagaatttttgcaatctatttaccattaacaaaacattcttcccctgcatccttgccgtaagcttcgacctcagccttggatagacccaccctcctccaacctgcaatcttttcccgtgttttttttctcttaatcttggtctatttttcctctctgcttcaccaacagttcatctccctattctttcttcagtgtcttctgaaaccctagaataatttgaatggttgtctttatgccctcagtctcagctattccataacaaactctccttacttagaatttgatcttcatgtttgtttacctgcaatggtaaacaggcttaaggcttgtctccttcccccgccctccccatacttaagatcaagtgggaggtttctattttaacatattaactgatgccttccctcattcttggaagctatatatgtgtacttcctcaagcgtgctactataaaaatacaaggaaagagacatcaaggatcaaataatgtgtttctcagtaattccctggaatctattgataagattagagccctgcattgaaaaatccttagtatattgagcaccaatgacattatctatctcgtaaataagagctgggaagattgtgtaagatacagtttgactcattccaaaggaaatgtttttcaacttccagctgttcaactggaacaagaacagtattgtaatggattatggtaagacacagtcgttgttatgagcttctgacaaagtactgtatcattccactcccactctgagactaagtttcagaaaccctatataggtttagaagaattccagagttaagatgtaccttgcttgctagaatatggtttgggaggtcaaatccactcagtcaccccctccctccccatcataacactagcacagtaggttaaggcatgaatgagtcaggtgtcaaagcaggcgagactgaaagtatgcttctgggcactccaggcatgattaaattggtatgaaaaggacacgagagaggacatgatatccaagggcttgactggatcccagtcatcgttggtggtgacatggggatagagaccaacagactgaatgattacttgtatcagcagaagacttcaagagaggatgactataggcttgtcatccccgatttctggatgtgacttaagtccctttaaatttaaaggttgctaatgccatcatgaccaactaccattgaacattttaactgatgctctgacctcacagctttttgacctgctaagctgcaatgactttgatcaatttgcgtccatgttcatggccagttcatgctttctcacctacctcgaaccatcctaccccatggatcacacacagtgaattgctcacttaaaccacagtatactgttcttgaaacttctgtcccctttttaaaattcaagtattatctacaatgtgacagatatcacatgaggttagattgaataatgatttagtttctgcatttctggagcttactgtctcaagaagatgaacaacaaataagagatgacaacattttacatgctaaggtagaaataaagtcaactgaaaaagaattttaaggctaagctataggaagccctttctgaagagatacaattcaaggtatgatcttaaaaaggagattttataaaaagggaagaattacagatagcaggcacaagatgcacaaagggaagtaggggaagtggatgctaaatgaagttagtgggcaaagaaggataaggggtaagccacagtagagatgttaaactaaatgtaatagagatgcttttacaggctttgggtaggagagatatgatctagtttgtgttttataaagatctctatggctcctgtcagaagacatcaaggagggcaagagaagcaatggaagactccagtgcctcatgcattcattttaaaactcttagtggtggctaatcttatttaaactaatcttagtggtggctaccacctcaccatcaggtaaatctccttctctcactcactgttgatcataattgctttatcaattgttagtcctgattttacccagcctccgattcttttagttccctttttgattgctatgcaattcctgaagtggtcatataacccaggcctgtaggtcctcaggacacatggcatttcatcaccgaccctttcctgctttgctcaaatgtcaggggaataagcccccctcctccttttaaaagctgacccctaaatatgtgcttttgagataattggctaccaacatctctaggatttaattctcttccctcctcgttcacatacacacaggcatctagatatggcaggcagtaggcattagagtgagagagcagacattgaagctacactcaggcctgtttctcagactttagtatatattagaaccacctggatgagcccgttatgacatgcattgcctgttaattctgatccaagtgtacagaggactacaattttgaggaaataattctaggctcagctttaccactgattaagtagccatgagtacatcaaggcacatttctgagcattcatttcttatatgaaaatgaagtaggttacagtggttattctctaaggatactctcagcactcacagtcccctattctgtgtctagaatctaaataaggctaggaaaaaatgcaaacataaaatgataacattgtaaaagctaagaatagttactaaaaattagccaaaaccctttgcttctccaaagtcgaataaaaatcaagtaatgacatgttatgtataattgccatcaaataaaaggaaaggaattttatcttagcctaagctaagggtaagattttcaatctgaagtccacagggacaagaccaagaacaggaacctaacaagtcctttgcaatgatctgaataatgaaacatcccttagatcagagtttctcaacatttgtttgcacatgaaacctctgaagatgttagtcaagtgcagactcgtgtgaggtctaggatagcgcctgaaaatgtacatttctaacaaaacctcaactggtgctcctagattgcagaccataatttgagttgcaaggccttaagtctatccctcacagcagctgtcataccaaattttcactttaacaacaatgaaaaccttaacagaaagtgtttggcactttcacaaaagaacagataagcttttcatgtctttttcttaaatctgtgttcacccattgttgagggtagaacattgcgacaagttcatttttacagagagccaaagtaagattccccaaggaagttttctgatattctctattgatacaaagattgagcttagaaaatgtagaagaatgaacggtcagcatgagccttgaactctggctaccatcaattgtttcctgccaagatgcatctcttttctttcctaaaaactgccagttttctctctcgcctggcttgtttgtgcaaggatcttctttcttctgcccttctcagctagagtcactgacacactctcctcctgtgagatatgcatcactcaataccatggtaggaggaggaaatttacagcagttatgatggactagaaatggccacaaaattatttgacacttctttcatcaagaggcagcatctaattctccccttaaagctcggatttgtcttagcaacttgtctgccaagtagaatgcaacgaatatgatgttataggtcttccaagattagatcattattagtaacttttagcctctttatgggtttcttagaatactcactctgggagccctaagatgccatgcataaaaactgactaccctgaaaccaccatgctgtagaagacatctacaagtcctctggttgacagtccctgctgaactgagcctttcagccattctcacaatggcattaagcattaagtgaatctgtcttgaaccctccagaccagcacatccactagctgaattctgccaagtgatgtcaactgacaccacacagagtagaaaaatcaataagctgaacacggctgaattcctgattcacaaaatcagataaaaagataaaagagatgttattttaagccactgtacttggggtgttttgttacatagtaatagaaaaccagaagagtatcctaagctccctctggaatggaggctctgccttgaatcacagccctctcgatcgagaccttgatacatgtccctcttcatcgactcttgaactctttctggttccctgatttactattgcctatgtttctatttaacagattacaccctgtctcccagcactcagtctcttcttagttacacctgaatttccccagtgcctgtcctgcctagtctgtattttctccttttcctccagcctacactgctataaccttaggatactttcaacctgctgtgagaaactctatgcaaagtgtttccatgataattttctgctcttttcccttctgtagggagatatgttttggctatctctaccagtttatctacttctaatttcactttaatccagtgccaggcccggttgtaagcaccgaagaataaatgaatgactattggataagtgaattagtgagtgaatgaataaataaatacatcaatgcatttataggttatggtctactactccactgaaattgttactttaaaattagtcaaagcaaccagaaaaccgaatggtcttttctcagaccccaagtaaatttcaattcaatcactgcctttggtcaatgtagtcacctccttaaaaactgtttttcttgctgcttctgtgaccagacactttacagtttcctgtgacttctcctaacacttctttgctggcttctctatatctgcacgtatttaaatgtgaattctccaagacttggttttgggttcctttttaactgtgtataatatccttttgccgtatcatctgcccccatggcttaaactccatattgattacccccaaaccattttctttagttgtggtatcttgcctatgatactttctcactgctacacctatcaaacacacactgatttccctcctcagatccagacatattttccggagattattggatatcccatcaatacatcaaagacaatatatcccaaatacaaatcacttccccatcatagttttgcttatttctatttctaaccatatccaatgataccaccatcctctcaatttttcagccctaagacataagttattttcacctcattcttgccacatcctttaattacatcaatactgatatccctgttgtctctagatacaaaatgtcagttataataaactctaaaatggtttcttcacctataatcctcaaatcttgacagttatccaatttagtctatgtagtacaactagttattttcctaaaccgttcttgtaagtactccaaccacagttgccccctagtgctttcttattctgtagattgtatttttgtgttctagccttccactccaccaacacctttcttcaaggctctgtttgaatgaattcttgattcccatgtgccttgccattcctttataaccaactccaaaaaaagtccctcctgatcttgcggtctctcggtcatttgttcatgtcccttaatgacatattgtcattatctgacttgaagttgttgtaggtttcctcactactttatgagcccctggctgaaagatatttttttttaatcccctactaaaactagcattgtctattgcacatagtgaatgttccgtgtttcttaaatttggagctgttgaacagtttcagttttcagctacattcactttttgactgagttgtaccataggtgacactaatctgtgccaaatggggcacatttaaactacttacactattactttaatgttttcattgaacgcaggaatctttgtagcctctaggtacatttaaactttaagataaaaattatattctgtcaaatgatttataatcaataccattgccaattaaaatcaaataatagacacagaagtgcctcaaagcttcaactaagatagacacaaaggggtgccagtggataacagtgttatttcataatcacagcttcccttttccctctagcaattattctgatgcagaatcagtcttaagaggtttctgcagctagatgtaaacaaagaagtatcattacaaaactcacttgactacacttctgacaccctggttggggaaatgtatatggattgatatgtctgactgacaagaactcaaaatttaaatgatcccttgtccaagagccctgtggttatcatttagaattcatctgcacaagtcattaagtatactctttggaaaactattttgttccggaaaaatgtaaagtcaagaagcaggaatgctaacatttgaaaaaagcttctttaataatgctataattctgaactttttgtttatattagaaaatattttttcttttaactctagctatagtacaattagagatgtttcaaaattattcaggtaagtgcttaattgggtccacgtaatcttctgaaagttagccctttagaggttatagccaaaaaatcgtgttttatccagatccactaagattccattaacacttctgcgtgcccacctccttggcttttgtggtctttgcttctcaaaacttctgtatctacatctctttagatgactgtcttcaggctagtaaagctgctttgccaacaaaaacagagatccggaagtgccttggtgtttatgtcaccttagggtagtcttaaggcaatgactggtgactactggaatacaaaagcccagctccttctgtatcaagttgcaacaagctgaagcatagtttaggcccaggttttcctgcagaaccagactgaggctggcactttgcctgcgattgctccttgcatgatttcttccccattcctattctacttctcttgctcacctacttgccatccctgagaacatttccttaattaaactactttcatgcaaattctcctctccacatgggctttaccaaaacccaacctgaaacataagcattcctctaattacagtaataaaggcatcagatttctatttgaaaatactaggaatgggccgggcgcggtggctcacgcctgtaatcccagcactttgggaggccgaggagggcggatcacgaggtcaggagatcaagaccatcctggctaacacggtgaaaccccatctctctctaataaaaagacaaaaattagccgggtgtagtggcgggcgcctgtagtcccagctactcgggaggctaaggcaggagaatggcatgaacctgggaggcggagcttgcagtgagccgagattgctccactgcaccccagcctgggcgacagagtgagactacgtctcaaaaataataaaaataatatggtgttaaactgattaatctttaacttcgacagaatgttagagttcaaacctgtagctctatggaggttttgattaccattataatccattaacacaatatgttactaagatagcatttcagagcacagtatgattttcttgtagctatactacaaaactacaatactacagtatctgtattactttagaaaatctctaaaaaagttgtgaattatactgccaatggtttgattagatagaatcttactgatttttaaataatatcaaatttttccatctctaatcatgaaaagagtggtgaggtagggcaggataaatcgtaatattggggccaggtgcaatggctcatgcctgtaagcccaacactttgggaggctgaggcaggtggatcacgaggtcaggagttcgagaccagcctgaccgagatggagaaaccccatctctattaaaaacacaaaaattagccgggcacagtggcaggtacctgtaatcccagctactggggaggctgaggcaggagagttgcttgaacccgggaggcggaggttgcattgagttgagacagcaccactgcactctagcctaggcgacagaccaagactacgtctcaaaaaaaaaacaaaaaacaaaaaacaaacaaaaaaaaaacaactaatatttgtatattaatataaactcctgaatccctcatgacataatatccatgtgtatcaagcctttttattcctgcatctgttaccgttattctccctatgcctctcacagccagaaggaaaactgaaagtctactatcttccttttggtaaaaatttgaaaagaagggcattcaggtagagatggcatttattaatgccagtgactgcggcagactgttcttgggccgctgggaagcctgtggtgataaacagcattggaggaagaaagagtcaccatttacatatggcacatgactctcatcacagcttgtgttgcttattcaccagtttgactttgcccttgccaaaaggttagacaacctctgctatgccctcctcatcctactggcaaattaccactttgttcccattttatgaaattattgaataaagatcaccattaatatttgtcttttttaataccagttattgacaagtgatcgtcgttcattcaaaaaatatttattgaatgacagttaaagagcctttactgtattttaatttccaataaacatatatgtgtcacatatttttaaaaatatggagaagttcagcgtttttgttttgctttactttggtaggttaatgcctgatgttcataatcttttccagttcaacaggctgggtgagtggtatggtaccataaaaaggatgatcagctggaaatcaagaccttcaatctctacttccattccctctaacaaacagccatggcatgttgtcatttaattctgagagagcttcatttccacatcttcagaaagacagaacaatgctagatgtacttgcatgtattccaatagtgattgcctttcagaccttcctcttctcccatttgaatagacattagcctcatgagtgacctccacacctgtactctccccatacacgattctgcatatagccaccaaatgtaactttctaatatgcaaaacataaaaaaaaacttcctggtttttttgaacacattcatctcaattgagcaaggaatcatccatccacattgtatccccagtccacctttcccgcatccttttcaattttttgccaattgcccatatcccaaaacctccattacggtcatgtcaaactacttactggttcctgaactcaattggtttgtgacttcatactcctcagcatttttttttttttttaatcagccaataggctgaaagctccaacagggccaaaaaaaaaaaagcctttttcagcttagtcttcttagcaactaactgattgtctgcctataaaagatgtttaatcaatgtttggaagagatggacttgaatggcctgttgtactcttgttggcatgaaaatccctttaagtttctagtctatagttgatatcaatttcaaccccaatacaaccctagccaagcaaaattcgtctcttcttccttctgctcccatgcatacccccgtggtaggacatactatatagtcttgtaattgcttttgattgcttttgaaatacctatttttcccatttatatgccatctcttaactacagtgccaggtatatggcagaatctcaaaactgagttaaaaagactaagatttctgggctaggcgcagtggctcacgcctgtaatcccagcactttagacggccgaggtgggaagaccacctgaggtcgggagttcgagaccagcctgaccaacatggagaaacctcatctctactacaaatacaaaattagccaggtgtggtgacgcatgcctgtaatcccagctactcaggaggctgaggcaggagaatcgcttgaacccagaaggcggaggttgcggtgagccgatattgcgccatcgcactccagcctgggcaacgacagcaaaactccatctcaaaaaaaagaaaaagaaaaaaactaagatttctttcaaacctgtaatctgatgatgattgtatgcaattctttttaaaaagctaaaaatcttagattgagttatttatgaatacaaacaggtatgaagcagaaaccacgaaggcagctggcaaaaaataccagagtaagtacagctaggaactgtagatgccagtgtcagtctacatctttgaactgtatgaaagagcctattggacactaagtatttatcaaattctttctctttgaagctagttctaaaaacaatagaaacaaaaggaattttagctaacttgctttaccttggctacagaatattttaaatctaacattccaaatagttcttaaagtattctgaactggtttctttctgtgaagacaattatgatttctgagtctatgaataattgtatacttacgcaatgttaggacagtattatctgtaaaatgatttgatgttcaatatttctactattaatcttggaaaagtaaaaaatatcttctatcagaggaaatctaacactctcaaaaataagttaaatatgatacaatggcagttctacaacatccagatattcaatagtaggcagcaattattacttgccataattcacatctttgaaaaattcaagagggcaaactaattttgccaatgtgaaggagctgtaagaaaaattatgctttaatggaaatataagatgtttttgttgccttaagtattgctttttaatccttgaaattcagtcaaatacttaataattattttccatatatcttattagacatattagcactcatgctggttagagattttatcttcctcagagccataccaacacacccttctaaaccctactttgcaacgctgaggcaaagactctgcaaaccgtacttctggctttactgactgactctcagaatctaaaggtagggagcaatagagggagactgcaagcctggaggagggacaaaggatttactcattcacactagcttcccatgcacttactgtccttattagcagttccctagacgtgcttcttcatgcctgcagcagcactttttagtaacaagctattcaatttagcttgtgttttgtttttcaaaagcttagagaatcagcttcatcgcccctgctgcagaaataccagcaccacctggctggcagaggtccgggcctcagtcccattgggcccttcctgctatcccagagagggtagcaccagccacgtagcagccccctactcagacctgagctcagctttgtagagtccttcctcaagggttctaagtgttagtaattctaaccttttgtcttcccagccctaggagcggtagctactttgtgcacttgctacctcttctctttgtcaatttttcaatacctagatcccaattcctcttgttacattattttctgctacagtcactcaagtggtttctgtctgttaactgaccctggctgacacatcatcccaaacccaaaacttgtcactatcaaaatggaaatacattaagtgttgggtctgtgtttaatgggtaaggatgatttctcattcttccaaagaccacatattatattccactattgttttctactacttttataaaataatgactaaatatagatatacttcagtacaaggatatttgatcttctggacagccgtatccatatgtgcattctttctgtagatggaactcagttgtattagagtcaaaaacttttttaaaaattctaaccatggacagttgaatcaaatctagccctgtagttatttttcaaagtcaacatgaatagtaaaaaataaaatattgtcaaaaatccacctggaaaattgctataccatccatactatacacataatatggattagattttaaatactgcgtagtcacctcctgcacaccaaagtttaggaagacattgagctaaactcaaagagcaaaaagccagagtgtatgcagctttcttaacatgcaattcttcctgcctctaaggtaagccctagattgttttctttacctgcagggctttctgcagtatgtcttaatagtaaagataatccagcacagcatttgtaatatgcttgtgatcaagaatggatggaaacaggatggtatagtcctaacttaagcatgtaaattaattgcatctcataatgtcagccaatccacactcttagtcatacagattaaagaaccaaaaggaacccaaggaaatcagaaagggtaattctgcttagaaagttgctcttacatttcatatacatggttgaagtttgacctcaaaaaaagaaaaatcaatttcaggcactgaacggcaattgtgtaacttatttattaaatttataatacaatgaaatctgagttttctattactctcatttcttatttggacactggtaattgcttctttcttatgcatttttaaagtataaatcctgatactagctggcactaccccaatattttttccctttaactttggaattttccttttaaaaaattgtcattctagagttaacatgctaccagcttttcacaaattaaatttgttgttagaaaatggcttccatggccaggcgcggtggctcacgcctgtaatccccgcactttgggaggccgagccaggtggatcacgaggtcaggagttcgagaccaccctggctaacacggtgaaaccccgtctctactaaaaatacaaaaaattagccgggcatggtggcgggcacctgtagtcccagctacttgggaggctgaggcaggagaatggcgtgaacccgggaggcagaggttgcagtgagccgagatcatgccactgcactccagcctgggtgacagagcaagactctgtttcaaaaaaaaaaaaaaaaaaaaaaaaaaaagaaaatgacttccattttatccaaaatttaggctcttaaaaatgtatcccttttcatgatattcttaatattaatgttctgtagatgttctatagaggcacttgaaataaactcaacatatctaataaagacagaaatggaaaggtaagtacataggttttctggttttgatgtactctatcccttgcctgttttttcttgaccaatacatacaatgttacttaaacatgccatcctcaatattcccaatgtcccctatactaagactagtcttgaccccagactgaaggaacttaaagttcccactaggaaatagtagggtgacataggaaagtaactcatccgaaaagattttctttagtggttcaacctatacaaacataccacccagggaatacagcaggcccagtgataattctagacatattcaacataatgatttccaatcaggtaggcaggaaatgaggaaaagctgttgagtgacagttaagtggcagggaaatatataattaaccaatcaatttaacaacaattagttaaaagcggtaccaacagctacttttattgagcccttactatgggccaggcactttatatacatcatctaacttaatattcaccaaaaaattcaggaaggcaatatttgtcaatattttgaattttattttttaaaccaatggagagtctgacagaaaatttgaacaagttgcaccaagtcctaaaactaacagatgttgctggaattggaaccaggaccatgtgctacagtaacttgctcaagtttctactaagctatgctccactctacgcaactctaagtttcatcaatacactggaactcatttcatatactcattccccttagtctattaccatgaaatacactaggttcaaacttgcaataagaaatcattaagggactcatcaccttacaattccaagtacagacaagtgtggaaatgatcctaccaaacaaggagaagtgtatcactgtcgcctttacatcttctcaggatgttaactttatctccagcttaatgacaagcacaaattcttgtagttcttaaatttcaggctgttctttagttttatagtacatatttaactgtatttatacccatgcctgagaaaatgctgtgtcttataaagtcatataatgctgaaggtcaaggaatatgctcttgccagatttgtagggatcctagcctagcaccactcacacgtaatcatttattaaaaattatttttctgatcatgatgctaatctgttcagagtcataggcccataaagacaatatttcctatgggttaagatgtgctaatctcattaactgaacaaaccagaatgaatttaatcacagcagtcaagggaagctaccgcatcattccaagacaaattagagatattgtacccctgtggtgttatctttgatttcgattagaggtttcaggctgcttcctatggctagattcaaaatattaagcctactaaagagaatgaaaggtaagtttatgactttgcatcttggaactgcactactgataactgcaaagcctaaggctttgaagagaaatgacaaaaaaaagtcaatcatattttcataaatattaagcttcccaattgtatataaatataaagaaaacatgcacattactttttaaaatgattcaggagataaactactggtataagtgatcatgttatcactaaatctcatgaaaaatatattaagctataacgattagcctgcttttaaaaatgtgtatgaaagtcagttattaaaagctagatgatgttgttaaataaagaaacttacaatgtgttgaaatttccctattggagaattataaaacaaataaaatagtgtttttctgatgcatcacataaaatgtagaagcgaaatttgagggtttagaatatttcaataaaatattaaatgcctgggcagtctccgtaattgtttcccttgagggggaaaaaaaaaaaaaaaaaaaaaacctttcctttcaggtagtaggcacacagttttactcaccccttgtctctccaaatctagactccaaatatatattagtcacaataaaactcacattcttattctgcttgactaatttgtagtcaagctgaatacaattcagtggaaactgaatatgaaataaattcatctaataaaaaggtaccaatgactgtataacaacatatgtagataaaagtgtatcatatataaaacattcaatcccacatggcagctttcctggaatataaaatcattttatcattatgggtattagctcatgaagtcagtattattttaaaaacatgctaagaatgttagcttcaaaatttaatatctcaaaagcaggattttggttataccaagtggtttataaaatagagatatttatccatacacagttttatgtgacaatttaggtgtccttatagcttcttggtgggcagtgtaaactggtaaaaaataataataataataattttgctaagtatttttgcgatacatataaagaccctttaaaaaatgttaatatcctggctgggcacggtggctcaagcctgtaatcccagcactttgggaggccgaggtgggaagattacaaggtcaggagatcgagaccatcctggcgaacacggtgaaaccccgtctctactaaaaatacaaaaagttagccaggcgtggtggcaggcgcctgtggtcccagctactcgggaggctgaggcaggagaatggcgtgaacccaggaggcgaagcttgcagtgagccgagatcgcgccactgcactccagcctgggcgacagagcaagactccgtctcaaaaaaaaaggtaatatcctttgacctaataatttcatgcgctggaagctgtctaaaaggaaacaaaatggtctactgggttatttagaacaacaaaaataaaaaactaaatgcctaactttagaataagtggtcattatgtgaacatttaaagtgtgtctataataacctaaaatcacttatgtgatagtaaaaaagggtgaaaagtcataaatatagcacgatcacatctaaataaatagcagaaaaccctcatttcgggtaaaaaggaacccaatgaaatatgccaaaatgataacaatgactttaagtgagaatatggttaattttgtttccttttacttcttccattcaattgggaatattaataattggacccttacagctgggcatggtggctcacacctgtaatcccagcactttgggaggctgaggcgggcagatcacgaggtcaggagatcgagaccatcctggctaacacggtgaaaccccgtctctactaaaaatacaaaaaattagccgggcgtgctgacaggagcctgtagtcccagctacttgggaggctgaggcaggagaatggtgtgaacccgggaggcggagcttgcagtgagccgagatcccatcactgcactccagcctggatgacagagcaagaatccatctcaaaaaaaataaataaataaaaagaaaattggacccttatctgttatatacaagaatcgactcaaaatggattaaagacttacaggtaaaacctgaaactaaaactactagaagaaaacatggactatgagaggtggctcatgcctgtaatcccagtactttgggaggttgaggcgggcagatcatgaggtcaggggtttgagaccagcctggcaaacatggcgaaaccccgtctctactaaaaatacaaaaattagccggtcgttgtggtgagcgcctgtagtcccagctactcaggaggctgaggcaggagaatcactggagcccggaaggtggaggttgctgtgagcctagaccgcaccattgcattccagcctgggtgacaaagcaagactgtctcaaaaaaaaaaaaaaaaaaaaaaaaaaaaaaacatcaactaaaagcttatgacattggtctgggcaaggattttttggatatgaacccaagagcataggcaacaaaaataaaaatagacaaatgaagttgcatcaacctaaacagcttctgcacagccaaggaaataatcccttttcaggtatatggtatacaaatattttctcctgctccatgagttgtcccttcactctgattaatatccaaaaatatataagaaaccttaaactcaatagcaatacaacaacccaattaaatatgggcaaaggacctcaacagactttttttttgaaataaaaaagcttttaaaatatgacaaagtaaaatcacagtggcaactgtgattaaggaactgaatttttattttttattttttttaagttctgggatacatgtgcagaacgtgcaggcttcttacataggtatacatgtgccatggtggtttgctgcatctatcaacccgtcatctaggttttaagtcctgtgtgcattaggtatttgtcctaatgctctccctccccttgctccctacgcccccacccccacaggctccggtctgtcatgttcccctccccgtgtccatgtctcaacgagcatgtcttaagggaaacaaatggacaacaggtatatgacaaaatgcttatcattagtcaggtaactgcaaattaaaacaatatgctatcaccccacacctgtcagaatggctattctcaaaaagacaaaggataactagtgttggtgagaatatggaaaagagggaaaccttggacccttaatgggaacataaataggtacagccattatggaaaacagcaggaagttcttcaaaaaaaaataaaaatagaactaccatacaatccagcaatctcactactgggtacatacctaaggaaatgacatcagtatatcaagtagatatctgcacacccgtgtttattgtggcagtattcacattagacaagatatggaatcaacctaagtaaccatcaacagatgaacggattcaaaaatgtggaatatacacacaatggaacactattcaactttaataagaaaatcctgtaattgggaacaatgtggttgaacctggaggattttggagttttcaaattctcaagtccaggcacggaaaattataatttttttttttggaaaaaaatgtgaaatatagacactattttctccgtctctgagcctagatactattttcctggactggatggagaatgtaaagtagaaacaagagtgtgttcctgagaggaggggatggtgaaagaaccgccaccacaacagagaaggttgggggtatccaggtgcagaagtaattgggtcccattccagagtccagcccaggaatgcaacaagactccaaagttatgtcagacccaggcaagaatcgtgagcatgtgtcttagcaaatggacatgagctagccacccagtacccaggcacttcagcaggatatagggtacagtagaataatttcccacatgcctccagcaaacacagtgctcaatgggtttttggaggatgaagaatgacaagggaaccaccatgtttcttgaccgtacagagatatgaaagggcctacaacttgaggccaaggaacaaggtccctatgggatgaattgtacatgaaatcaggtaagccacacccgccttcaaatcctggcactgtatcagtgtcaggactctgagctaagccatcatatcccctgtgacctgcccttatacatccagatggcctgaagcaactgaagatccacaaaagagtgaaaatagccttaactgatgacattccaccattgtgatttgtttctgccccaccctaactgatcaatgtactttgtaatctcccccacccttaagaaggttctttgtcattctccccacccttgagaatgtactttgtgagatccaccccctgctcgcaaaacatcgctcctaactccaccgcctatcccaaaacctgtaagaactaatgataatcccaccacccttggctgactcctttttcagactcagcccacctgcacccaggtgaaataaacagccttgttgctcacacaaagcctgtttggtggtctcttcactcggaggggcgtgacaatcaggtcccctccagaaatttaagacaaaaccccagagaaagggggggcatctcagtcctaaattggctgagatgaaatatgcaggatctaccggaaagtaggctttatatataaattaagttcagattcaagaaaaggcagttattgagattcactgccactgcatgtagatccttatgtggggatttctaagaatcattgtccagcacctaaactgcaaagcaaaccggtaataaatcagacaacaattaagagccaagtcatcttgagacaagagctcaggactcagagaagcagcctgcaaatgtgaaatggacattcagaagtcagtgagtttctgaactagcagtgcccggttacgaagctgttgaagagccttgtggactgctttatatgttctgggtagttccataggtcctcgcagaaagagaaaataaacctttcgttgaaattaaccttagacctagattcttaaaggactcaaacttttcgcggggaaggaaaggccagtctattgacaggagctgtagatattaaggcctgtggggggtgggggagggggactcattatctgggaaaagccacacccttaatccatcataaacagtgatgcctggggcacagttgagactacaccttggaggaagaatctaggtttttcctatccaactccaaaagaaacacatttcaatggcaactgctgaaaaacaagcaaacaaaaagtaccagcacctttttgtttctttggtaagaaggcgaaacatcccagattgtctaaaaaaaagaaattcgggaaatcagaacgttttatcatgatctggggttatgttgtccagtaagatagccactagttatatgtggctactgaacatttgaaatgggactagcataactgaggaagccaaattttcattttgctttatttttgcttcaattttatttatattgaaaacaaacagtttttaatattcttccattaaccataacttcattggtttgggagaacaagtttactttaacccatgaaaatatggcaactgaattcagatgtgctgtaaatgtaaaatatcctccaaccttaatgatttagtacattcttttcactaacgtaaaatgtctcattaagtcttttttgattacatgttgaaatattttagctaaataaaacattaatgtcacctgtttattttcactttttaaagtggctactcaaaaagtttaaattacatatatagcttatatttcttttggacagcactggcctggagtacagttcaaaaatagggcaaaaattcagagttacttcttccacatctgagttttgcgaacatttattcctgctacatacacaccagtctgtgtatctacacataatgaaaaacagacttttctcaatcccctcatatacagagggcaggtgagtgagccagtgagagaagactgagaggtaagtggatcatataaattaagatggcctaacaacattagaatcattaggatttaatcctataacttatgacaacagtccaagatgcaaagtgatttttaaaagtgatctaaattaaattttctagttttccttttctttccctttaataggtttcatgaaaatcaagaattataaggcggggaggtaaggctggagaagacaatctaataaagcgatgtaggacaaatgagaaaaatcaggcttccttattctactccaacactttccaactgtcatgaccttcatggtctgtctgtacctcaattctctgatcagtaaaatttggatgaaatatgctggactctgttgagacaaaatgaaaacataaggagagtctatcatctgtaaatcactacattatgtacccattagtattttattgttagcaaagattaatagaaaactgacaactccaaggctggatggcatgaagccctacacctagtagttgctgccatagtctgatttgaggttcctcaaatcattcttccccagcctaatcattttttctcttcagacctggaatcctgccatcctctcgcgtcatagtttgggggttactgcctgcatatgccaatgaacagtatagccacgtgacacagaaatgaaggccacagaaccataattcatcagttattcaatgtgttagctgacaacttggaaatcatagagcactcaactccaagttacttcctgaaaagcagagaaatgcttcctcagtgaggccacagaactcacagctttacattttacctacaatttgcacatgatccacatgatctggcctcggctttccctcaaccccttacaactgttacagtttcatagccttctgtcagtcactagacaaaactcagacacttccttccagtactggcaacattactgcacattcttcttttaggttttcagccctggctacacattagcatcacccgaggagcttttaaatctgtaccattgtgtgtttctgatgccccccacgccatgttgttttgtttgttttcgttttttgttttttgtttctttgagacagagttctactctttttgcccaggctggagcgcaacggtgcgatctcggctcactgcaacctctgcctcctgggttcaagcgattgtcatgcctcggcctcccaaatagctgggattacaggcacctgccaccacacccggctaatttttttttgtatttgtagtagagacggggtttcaccatgttggccaggatggtcttgatctcttagacctcgtgatccacccgcctcagcctcccgaagtgctgggattacaggcgtgagccacccggcctctaatgccccctttctttcataacattacacaccaagtattatttggcaaacttctcatcccctatactgtattacttattgacattgtttcccagctcaggcctacacgcttggcacattctgtctctctggccacaatgatcgtgtaagcaaggctgaaaaccaacttaaaggaatgggaagagttacaaacttaagtctcccacacatgatgcaggatgatgactttatcagatattttcatgattttatgatatttatcagacattttctcctgggaagtttatgttagagtaaaaatcatgtatcattagggagtagaggtaatgctaaaagcaaggactgagagtagttaattcatgagaatgaatgatggaatcccatgacgtgatagatcagctgctacactatggtctcaatagttcaattattcataaaattacactgatcgtagttttctaatgtgacatttttgttttgattattcggttggtcagacaactgagtaaccaaatggtttcgcctacttatttggttattcagttgttcagtttcttgacctttttaccccatgcttccttaacataagctgaatttatctctgttcaatgtaacacaaaagcccgtatttagagccagattataccagtttccagctgtgtcctcttaaacatattactcattctctcatgtcttccatttctttccttaaaaaatgagaataccacctatctcctatatatgtttgcaaacatgtttacaagatatatgtgaattaccttgcacagttagcatctctcaggatgtgaaagtgaccgtcttcctcctcagtaatttactctttgtcttatcaaagccattaaaacccctcagaggtgattaaatttgctgtgataaacagtggggttattaagcaaagtagtaaactatgaacacacctaagttttttcttaaatattgtagtggagctggaaatttttttttttaggtatttcttccatatccacaaaaaagcagcaagcccactgaaactcatctgtttgtgctactaaataatcccctacttttcctactgtaggttgatttattggtccccactttctcattcctacttaataggatggcatatctagcctatggtgggaaatgtgatagcctttggtcaacggggtgttaagaaaacatgacaggagcagagccttgagatgggctggcatgtttgggcttgctatctagtgacaacctatgaaaacatgcactgggtggccggtgccattccagtgtgtgcctctggacgtgacacatcaaagaaatccaaaccaaacctgccgctgaaagccaagcctagcaactaccagcctgatgcagaaccaaatctagatcaacttaggtcagccaaaccccgcatgaccatgagaattaatgctatttaaaaccattaagttggaggtaatgattattacttgatattattgttttgagagctgaccaatacatctgcccaaataaacgcgtttgttcacatcatgatgttgtactgaacccctataaccctcaatagcgaaggcatcaggttcaagagactgaggaagaaacccatagccagcaaacgaggcattgggttttattagaggtttacatacaggggagggaattcagtagtggtgggctggacaggagaagtgccttacctgtagaaacgatccagtggtggcagactggacaagatagcctcgcagcacagtggtagtgatggcggcggtgggatgagcgggcaaaccaacgctgcttgcgggcagcatgcagtttatatagcatttttacttaaccctctgcccttaatgacgttcacctggcaaccttcatccaacccaaaactcggggcctcaatccgctgtatgtatggcccgtgttccacgggatgcacttggggctcagatgttcctcatagacaaggaagggctctcttgctgggctactcccagattccgtagctcggaaaacacattcaggtgtgtctgcagtacagggtcattctaagggtatgcgcacattattgcaatcaggtgcatttaccatatacttgattacctatcttactggttatgttgttgttttgtgtgtacgtgtgtgtatgcatgggtgtttttacagagtcagatgtcaaccgcagggacaatacaagtgtcttactcatttcagcctgctgtaacaagataccatagactgggcagcttaaacaacagaaatttattttctcacagttctggaggctttaagtccgaggtcagtgttccagcgtgttcaagttctggagagggctctcctcctgatatgtaaacaacaaccttctcctgtgtcctcacatggcaaagcaagagcaagctctctggtgttttctttacacgggccaccggatcagagccccacctgcatgtgcttatcttaccctaattaattcccaaaggttccatctccaaatatcgtcccattgggggttagggcttcagcatatgaatttggggcaaacacgaatagtcagtccataacaacaagtgaaggactacagaatctattttatacagtaatattttcttttatgagctatatgaaagtgacaaagcaagtggtttagtattgtaataccatgacaaagattaagaactgaactgagcaaatactttatacttctggttcagttcatcataactgaattacccaaaaatataaaaggagagctgtagttgttctagaaaaatcttccttcgtgtaggagtgggtttgcgggttactgtgctaatccacacctggagttttgggcgtcaaggttgataagggtcaagggtttgggttttggctctggcttgtggaagatcgttttctgagagcattcttgggcaccagctggtcagacactcccattccaatgggacatagttttcaacagagaggaataatccaggtgtatataaggcaatacaagaaaccttgaggcttccaggccttagcaagaagaattggagtggaagtttaaaagcagaactggaacattttctaattgagggtggtagagagaattctgatatttatatattcggctgaggttgagagctttcaaggatgctgagctggctgctggcttggaatgaacgtgtgtgtgtgtgtgtgtgtgtgtgtgtgtgtagtgtagtgtaaataagcaacattgctagtcttgtaatcttataattgttcataagagaaaatacagtctagaggaagagatcatctagtttactgggaactagtaatgcttatcttgccgaggtttaaatgaatgatcacggctgtaatgacttataagaaaaattaaatctaagagcacagcctctgagcagaaactgtatacagaggtttatgtacacagctgtgcgatgaaaagaattagatgtgctgtgccctgatgcttttgcaataaagggttcaaaaatctgtggagaacaccctactccttagtacaacccagagcagtctgctgtagcctgcttaattggtatgctatgatcaaatccctcttgattacacccctagggtataataggaggcaggttttactttaacgcctttcatcatacagaaagtaaactgctttatggataaaaatagccatgtacagactcactattgacaccagccacccctggtgacttcaaggctcatcagcaatgcacaactgttttaaaataaagcaaagagtcacatgtagaattggaattacaggaataatgagaagtaaacagaaagaggccacgttgccttgagggctaacctatagattagaaaaaaatcggggccctaaaagacacactactgatggggtctagggatagagctatttttaaagcagtggtaacaaaacaattggtgtcacgtaacactccagtaactaagataattcacttgactgcaagacaagcaaaatataggatgttaaatgtgcaactatgtctcaaggttacccaagttaaaatttggagcaactaaacatgtctcattttacaatgacaaaatgaacacttagttttcactgtgtttaagaaaagtgtctttgccacattaaatgcattatcaggagatacattattatcacagctgcaaggaaaatatttttcagattcaaagattcaacaacactgtggtacgcagaacttgaattgctgtcagatgaaaagttaaacgtcagcaattgaaacaacaaatattcaggacaaagtgtttatagccctttcttttgagggttttcacattgaggaagtatgctttttatcttctccagtgatactttaacatgggccttcaagcacctgaataacagcaattacaaaaatatatttttttcatcaacgactgggcattttatgcgttttttttattttgcctattaaatatgcccttaaaatcgtgcttgttcctcagtctacttattagaagttcaaaacaaggctttggttcaaatccagtttctgagataaatttcttaattcattgtaaaaaatattaatggtgaccaaaattttaatgtttttagaaaacatcacaggtaatcagaacaaacaggaataaaaagaacaaagagtaaaggaaggagaaggaaggaagaaggaaaggggaaatataaggaggagtagagaatgaagaggtgaagggaaaagctgtgatttttattttcagataaagcacaggtagagaaaatctatgacattaggagagtctttcatttaaaaacctcatagttttaggtaggagggttcttattggtggaatctttcatacttgttcaatccaaattatccattaattgttctgtctgatttattagctttcatcaaataaatatcattttctatgctttagcaacttgaaatcatttgccaactgttgttatataatacaagtcgaaaaagttggtatgcccaaaggcttatctggattttgtattcattttttccattttgaagttcaaaacaagtcatttctttttctttattctctgcaatcaatacaaaatgtgtgttcatactattaagaagagcatgactgttaagaagccttagttcaatggattagtagacaaccatttttttaattagtcttccccctctgaacttttctccactttccgcagcaaatggaaacgtaatgagaatctcatagtattctgccaaaataaaggggatgtcaggcaataaagcatatccttgctaaatagcatcacaaatcccatatgtagaattatcattttatttttaagagttttttccaccaaaagccaagaataaaattgctttgaaggataattgttaaatggttatgctttggctctatatttgagcctccacgtaagtctttaattaataatttgtgctatggaccgtgttctgatgagatgttttgctaaggagatatgctcccttcccttactgccacccacaagagtaaataaaagcaagacactggcgttttggaagtcaaactgggattctgaagaagttcctgggctctgagtatcatgctacacagtagagagtcacttcctgcctctctaatatctaaaacaaaagatttgaactggtagccattgatctaattcaggcctgagatacatttggctagtttgatacaggacaggttaagccccaaaatcagggcttggcctgggaggattcttggctttgcctaggaaagaattcaagggcgagccagtggcgttaaacagctatgttttagtgaacattactgcgctttgtgaaatagggacaactcataggcagtgcctccaaagttggcagggtatgggctgctggctactgtatttatatccatttatacccactttcaattacatgtaaattaagtggcagattaatgcaaattgagagacaggttatttagaactttctaggaaaggggtggtaacttctgggttattgccatgtcctttgtaaactgtcatggtgctggtgggagtggcttctgctaatatgcaatgagggctgctggggatcacttttgttgccatctgctggtttctgctgtttttctcacttccgttggtcgctgcctgctggtacctgccagtttcttcactttatcctctgggaatgggaaataagtcctgcccaactcctacctcaggcttgcacagaatttttaattggaaaacctttttccagttacccaccaaatatacatcactgcctactatatatcaggcactgttccaagtgcttgggattcaccagtagacaacatgcacacataaaaaaaagtgctcaacttatgaggcaaatatatagtgcactgggatgttttacatacaactccagattcttaagttcctcttgaaaaataaaatatatggccaaaaatagctctacattctgacatggacactgctagactgaattgattagcagttgcccattttagactgggcacaggcgtgccatttgccagtattctttccaatttacacaatgtccgtatgcatttagatctttgcttcacctatttccattccctttcaggtccttgcaggtattttaattgtggactccattcactgtattattttattttatttcagttcagtttgtatcattttgagttcctgtttttaatttagtataatatcatagaaagtgtttgtacttaattctacggccgggtgcggtggctcacgcctgcaatcacagcactttgggaggctgaggcgggcggatcacgagatcaagagatcgagaccatcctgaccaacatggtgaaaccccgtcgctactaaaaatacaaaaattagctggtcgtggtggcacgtgcctgtagtcccagctactcaggaggctgaggcagaagaatcacttgaacctgggaggcagaggttgcagtgagccgagatcgcgtcactgcactccagcctggacaacagagcaagactccgtctcaaaaaaaaaaaaaaaagaaagaaaaagaaaaagaaagaaagaaaaagtgtttgtacttaattctaatgcagaatgttatggattcttatattggttctggtataaataagctaaataaatttaaacatgttttttaaactctgtgtggtccaaatatattctcagtaaagtaagagtttgacttatttgtgggtttgaaattgagttcagttgaaactcacaattcagttgagctgctgtaatttcagttttatggttccgtcttccttatgctatatatttttaaaagaggttttgttgataaaaaaaagaaagtttgtgaaccactgggctttctgatctctatgatctcctacaaatttaaacttatgtgatttaacactaatcaaaagcaaatcggtattcctatttaactttttatatacaaaggtcttatttccttaaaattccctaagttggaataatatcttaaaagctgttcttccatagtgtcaattaagtgcataataaactaaaaatatttgctgaaaatacatacacatctggtaaaattgtgttggtatgaataggaataataaatacaaaaatgaaaattgggaagagagaatagtggtgcatttgggaagggtggcatgtggaggagggcttctagagtattagtcatattctagtcaatttttctttaagagaagggccctcactctgtttcccaggctgaagtttagtggcactatcatagctctcagtctaaccttgaatttctgggctcaagccattcaactgcctcagcctcctgagtagctaggactataggtgcatgccactatgcccagataattttttaattttttcatagacttaatgtcttgatatgttggttaggctggactcaaactcctggacacaagcaatcctaccacctcagcctcccaaaactctgggattacaagcacaagccaccacacccagccccctatttcttaagtgaagtgattatgaggaatagctcaattcattattgctctatattccttacacatgtaaatcttatatgtacatctatagcaaatgaaaaaaaaggaattttcgttgatatttcctttaaatgaagatcacattggaggtcaaaatgtcacaccaaaaggaaagtaaaaaactcaaagtaaagatattttgttaaaattatgaagtgttaaaattgcaaatgacatctcatttgtaaatattgtattattatttattaagaattactcgaataagccaaaatgatgaaaatgcttgttatatagagaaatctaaaatgtaaggcagtaagcagctactcttccaataactccaaaagatgaaaatatgtttggtatactaaaaaaaatctaatctgtaatgtagtcagtggtatattttgaaagaaaagtaaaactatagttttgattatttataaaagaatgaattattttatatttaaaataattaagtcagagttaaatagtagtaacatgtaatttttaaaattgataggaagtgtatattatacaaatgtgataaacagcatttatactgtggaaaatttgtatcaatgacagaaggtaatctcccttcttactacaattcttttttaaagggaaaagaatataaaagatgaacaagtgtacagtctgaaaaggttaattttcttctttaaaaatttcaacactttgaaagtacctgcattcaacttctcttcaaaattattacttcttaaactacagtcagccaagcaatttgctattgagaactctcaaaatccattattaaatacaattttcaaacatacccagttttttgaaacacaaattttaactttgcttttgaaactgactgatgagaaattacctaactttgaaaaaatattcattaaaaagtccatattccacctagtcatgtgctaaatatcagcattataagcagctgtttcaaaacctagttttatgcaacatgtgccctttttaaaatttttcataaaatgtaatatctgttggtagcactactaataatattataggaaaacgctgaattacgatcatatagaaaattataaaatagaaaaataaacagagtttagtatagagtgtctgaacatgtgtaaagcaaggggtcagttgcggaggacgacttattgagatatttgtaatatcctttcatctacttttatctgttttatagtttcctagtaaattataagcagtgattacacccttaatctttggctttatggaaaagtataaaatcgctcttcagttttattatgactgtatatggatattctatttacaaaaacatatgctattacattttggccaatctttgtattaatttttgtaagaatatattgtgtaagtatttatagggtaataatacatatcatacgaatgttaagagtgcaatagcaaaataaagaaccatagccaaaataaattcctcataagcaagcatcacacacacacaaacacacacacacacacacacacacacacacacacacacgcagaaacatggacattttcttcactgactcagaaaaaattttcaggtaaaatgtcctgtaaatgttcgagtggtcacaagtaaaaatttacaaagtgtttctatagttccagcagaaagcgaggtgcattagaagaaaaatattcatgatatatttagaaagacaccaaattttgataaaacaagtggtaactcagtttaattaaccaaatatataccacatgcaaaatatgtcatagatactgataattcaaaataagtattctctaatttggaaattagcaacacacatttttgtgtatatatgtggacagatatattaatccatccctggcataggagtatcccaatgtactaatttgaactcttataaagcattcagttcaatataactcattaaatggccctacagcccaaagaagaagccatctttagtatgcatgatacaagctttcatttctataaaaagaaatggcaaaagattagatttgcaaagcaagataaaaagacacttgtcagctcctagatcttccaggaagcagcatatataggagaaagagaaaaaaggtaaaacatgattgatataggaaaacagctttacattataaattgtatggtgtctatatacgtgggaaattttctaaattaaaaacaagtcaagaaactataaagaaatttggccaggtgcggtggttcacacctgtaatcccagcactttgggaggccaaggcgggtggatcacccgaggtcaggagtttgagaccagcctggccaacatgatgaaaccccatctctactaaaaatacaaaaattagctgggcttggtggctcatgcctgtagtcccagctactcaggaggctgaggcaagagaatcccttgaacccgggaggcggaggttgcagcccaggttgcagcccagcctgggcgacagagtgagactcagtctcaaaaaaaaaaaaaaaaaaaaagaaactaaaaagaaattttcatttattatcagcaactaaaaggattaagtacaaagataatgtaactaagcatttagaggggaagactggtatgtgtaagggtatggtataaaaatcataactcttcagaagaaacaaagacttttgaataattgcaatgaaatgtatgtaggtagggtggggaaaaagtgggagaagaagggaattacagcagaggaggcgaggtagaggaaggcaaaaaccaaattacaaagggcattttgtgcaatgctgaggggtttatttttataataaaagctgtagggaaacgttaaagcattggtttccaagcctagctgagcattacagttacccagggagctttcttaaaatgctcactcccagtccctcatacccagagattctgatttaatttatcttgggtggagcctggtgattttcacatgtagctaaggttgctaacggctgtgttaatggattttaagtaaactacacaatcagatttatattgtggaatgaacactaatcctggcagtatttagactgattttggaatagactaaactgcactggatttcttatgatattatcattataatataggaaagaagacctgaagatctaaagtgaagccaggtagtaaggatggataaggagtgggagtggcattcatagttttaatgcgactggaacacgagaagcaagatatcatagtgattataaatattgactcgaattcaaactctactcctgccactttgttgttgtgtgaacttagacaagttacttaaccactctaagtctctttttgctcatatgtgaaatggaaataataatagctgcaccacagaaattttcaactgtcaaaccaggtaaggaagttaataatggataacaatatcaaagatatagcaaatattcaacaatggacagtcattatgaaaatctagctgtctcagtaaatgtgctggatgaataagagggaaaggtgtagcttggcttctagaatttatatgtaatcttttttcttaaaatataaaatatatagagaaaatctgtaagtcataagtgactcaataagttttcacaaatgtaatgcacccatttaaccagtatcagatcaagaagccgaacattatctaaacttcatacccctttcaagtcatgtctcctagggtatttatttggcccactaaatgtttagaaatagcaagagaaagattataagaagaggtgtagtagagaggaagataggtttaattttggataagtggggtcaagagcctgtgggatattcaaatggaaaattcaagaaggttttgagcagaataaagggtaagtcatagacactgaactgacagacattagcatcaaagcagtagttgacattaaaaatggttcttttcatattttcttttctttttttggagatggagtctcgctctgtcacccaggctggagtgcaatggcggatctctgctcactgcaacctccgcctcccgggctcaagcaattctcctgcctcagcctcccaagtagctgggattacaggcatccaccaccacacgcccggctaatttttgtatttttggtagagacagggtttcaccatgttggccaggctggtcttgaactcctgacctcaggtaatccacctgccttggccttccaaagtgctgggattacaggcatgagccactgcactcagcccataatgttttaatggtgtatgattcaagtgactaggcataatatgttgcttgtctcgttgctcaaaaagtaagaaaaataaaagaaagagactccactcttttgctaggtttaacattgtgttgttgtatgtatatatgtatttctgtacacatccctatattgggaccatatgaccttccacaaagaaacaatcttacttaaaattgttttaaataaatatgtaaaaagtactataaaattttacattattttgcgacagaaatacaagttttgttactgattagagatgcagcaacagtttgcttttcaactacattaggaaccctatgagcattttttagataatttcatagtaataagtaggaagtacataagacataggattcactaacttggtgagaacttaattgctcacaagagaaaaatgctagactaatccccttagcaaagaatctatgattaaaagattctaaaaaataatttgaacaatttccagttaccataaaaagacatggttgagaaaaatgcaactttttgctattgatattcaataaatgtttactatatatataagttggggctgagtctttctttcattctttgggtcttagcataaacaccacctcccccaacaccacctgctctaaattaggtttcactggccactctcttgtccccttgtccatgagagcacccaacataatttgaaagtatacatttaattgtttgttagccagcttattgactatcttctccttaatggattagtttgtgaaagtttagaccatattcatttggttcactgtcatattcctggcacctagaagggttgttgacgtattgcagagattctcaatcttggtgctactgagattttgcacaagatgattctttattatggtgggttgacctgaacattattacatgtttagcaacatccctggtctctacccactagacaccagtagcaaacatctcttcttttagttatgccactaggaatctctccggacatggtgaaataacccctggacggcaaaaccacccagagttgagaatcactgaataatttaatacataaatgaacaaatgagtgagtgaatgaatgaatgagttaatgaataactgtctgattgctcagaaaacggaagtagaagcaggagcaaagcacattccagtcagatagtgatatggtttaaattcatgtccccacgaaatctcatgttgaattgtaatccctaatgttagaggtggggcctggtggcaggtgattggatcacggtgtttctcattaatggtgtagcaccatccccttgatgctgttctcgcgatagtgggctctcacgagatctggttgtttaaaagtgtgcagcacctccccacttgctgtctctcttgcccttgctcccaccgtctgagtcacctcgctccccgtctgccttctgccatgattagaagcttcctgaggccgccccagaagcagaagctgctatgcttcctgaacagcctgcagaaccgtgaaccaactaaacgtcttttctttataaattatccagtgtcaggtatttctttacagcaatgccagaatggactaatacagagggaacagtaaataagtagacaccgagggacttgaaagcttattacatgcaagaactaagacagagctagcttgcctggagctacaagagcaaagctgaattgaaatgggcgagggaggcatggtccagttatgtaggtcaaggttaaaaggtttggaatttactcttggtagaatgagaggcgttttaatgaagaggtgagatgatttaattgatctttctaaaaggttgctccaaatgctgaaattaggatttatagatggggtcaagactacatgagagagagcagttaggatgctatttcagtactccaggaaggagctgatggtacacagaagtgtcaaagttgagagggactgtactaatttgtaggccaagccaaatcaatcggccaagcaaaatggattctatataaatattatgatcatgaacaatatattagaatgacattatatgcataagacataggtttggttattttacatacatgtagatgaaattaaagaactaatttcctgaaagattttaaaaatcacttagtctctgtatttgttgaatgactatgatatcatccaaattccagaataaaaacattctatagtgtaaattcatgagaaaataccctattgagtattattggccttataatgcaagcttcacttaactttacaattgtggaataattttctcactgtgatgttcatttcattgcgtgaaacaggttcagtacattattcatgaaactacttcaaaatgctttgttttagatttaaaaaatattggtattcacataactgctttgccaatgtgaggtttcatacgaaattcattgtttgattttctgaaaacttatcatattgattttgtgtcaaatctttatgaacaagcatttttataataaagttttattcttttctcataatctccttcccttcatatctcactatagattgtactaaatattgtatctatccttcatgtacatacagttctacgaggaaataagaaattcaagcggttcattgaattaatcactaataggagagaattgatcaaaatttgctgtaattttcttccttcaaaatcatcagaattctggtaaagctttgtatttcataatttggactccacatattggtgacaattcagacactgagagtggaacacaaaggaattgggtaacgagatcactaagggaatttttagcctagtaaagacagtttctcaacattcaagaataattcaattacataaaaattcatataatagtaattaaatgacaaaatacttttgaatacttattaatgcacacccctcagagacctgaaatttgcaagactatatagcttaatttgaatttgaattttcttacttattttagcaaaataaacttaaggttcataagaacatagctcttcattcacttatcttggtcgtaaatactgttaaacacaaaatcaggtgcccacagctcacaaatctacacatgacacatctctttacgttcctcctgacctacctcagcccaaatccctctctacctcatagaatttgatattaactttctgctaactttttgaaaggagaatagttctgttgctacgagtcacccttgaccctttgcaagaccaaacatgccgataatttaaaatgtgatgtaggctctaatcaataattaagtgttgttctattaacttatgatatatcacatactttatttgattcagtgacattaatatcatcatcaaacggtattataatttctcatattttaatctcctgttctaccatgcagcagagcacagctgcatattatattttccatgggaaatatcagccatcatatggcttgtagtcttccaaatttctggcctacttttcaaaatcaaatgtctacaatttccaaaaaacactgaaaatatttttaaagtacattttgcaccaaacattttaacttatgagtaatcaacctttacaacatttgaacgtaaaacggaagtgctaaaagtctggcagcaaaaacaacctttcagcattttatgagagatcctgtatcgtcatattggtgaatttaaaatgattttaagttctttctttcttctcatgagactttagatctaagcagtctgtctttagcactaaccgggatcacttcaatgcaacattttcatggaacacagcatttgctgtcaatcaataagattataattacaaaataatgatgccttacagacccattctaaaaatactttgacatctgaatctatgaaagggctcaaataccaaaaaggatcttccagattcacatgaataaagttcctgaggtagttgatattttaaaaattccgtgtcatgccaattatgtgaacctatgctggttagatcacacctgaaaatttaggatgtattgtcatggtatgtgaactgactacaaaaggtatcaggaggttgatatttgctacataagagaaagatgtgttcaagaaatcctcacacctttgcatctcactaggcaaatgggttaattacatctgaaatcatatttcgatttggttgatagtctgataagttaatttaaggtgaccctggtaccatctaactgttttgtttttattccaaataggatattggccctttctaaaaaggattatgtagtcttgtctatatgagcaaaaaaaaaaaaaaaaaaaaaaagtaacctgagtataactatggtactaagaaagaaaatcagtatacacaggtaggatttatctgccataaagaatagttcactgctataagaatttcttacaagaaactctactggataatcaaccttctagtcaaactccagggaattcaatgtagtttaaactcaatacatattagggaaatcacaaaatgaatcatatgtagtcattctatggatgagttcacaatctagatagtatttccgtgggggtaatgaggagtatctcgccacgtcagaggagtgagtatccttctgccttcttaagtataacacatatagttaacataatattttcttgaagtaacagtagagagtcaagccttgtaggagaacagatattttctaccaagtctcagcttagtctgttactcagttttcttgccatagtactctgcaacatgctgaatccacggtttttgtagaaatgcgtccacaaaatttatgccatgaatgcaacaaaaaagcagtacacacatccagtaagaaattgaattcaatcagtagataagcttggccaaatatttgaaactcaaaaactaaatcattaattgtgcaaaagtaaagaaaaagtgggaaacgaaattaatgtaaaatattccaaaacattcttactatttttaactaagaaagcatattttactgatgtctgcaagccttttgttcttcactctttcaattctctaatcctgccatccaccccatatctttctttcatttggaattttggtttacaacactcagttgtagactcaggcatataacttgtgttttagtcttattcctttgcacaaagacaaaatacatagacaggacacattgatcagaaaaccagaaataatctatttctaaaatttctaatccctgacataaatgtatcaaaatcacacaataatttaatagaatgagaattgcacacacacacacgcggcacaataaaacccaaggtaaaccaaagcacaacaaatgtccttctgaacaaaaaggttttccagacagctgagagctactcctttggatgacagaacacctcaacttctggatgaaaggtttacatgaaaatgattatgtaggacagctctctttcccttcttatgtatggtatgtctaacataatattttcttgatgatttagggttagaattatgatgtgaagatatgactgtggaaggattgatcccaggtacatgtggatgttcacccctagaatgcaatttctttttcttttattttttttagatagagtctcacactgtcacccgggctggagtgcaatggtgtgatctgggctcactgcaacctccgcctcccaattctcctgccaagcgattctcctgcctcagcctcctgagtagctgggattccaggtgcccgccgccatgcctggctaatttttctgtgtgtgcatttttagtagagacggggtttcactatgttggccaggctggtctcgaaatcctgacctcgtgatccgcctgcctcggccccccaaagtgctgggattacaggagtgagccaccgcgccccgccctagaacacactttcttagaaagtttcaaaatatctttttactgttacagtattttaggaatctgaacacttattagtaaaaggaaatatgaacttgctttctctcaagtagtatctttctttctccacaaagccatgtcttagagctctttcaattatgggtattaaaccagtatgaccagaatctcagacaacagacactatcctgtccacacagagctaatgtttatccctgtctgcagtcttcatcaacagtttggaaaggaaaagtcaccctcgctatttcaatattttaagctgacacattttacgaattcctttacactctaaaagtggtctatatatttattagataggacttctcaaggcatgatatagcctagaattttctggaacctctgaatcctttattgacactgaaggtccatgatagtgcctgcaaaatgattgaacaatactaaatcttgtaaacaatttcacattatatttgtaatgtaccacagtcattgatcttatgaatgatggtgaaactggcggtgggaaagagaggtaaacacaaaaatgtgtatcctaacactaaaccagtttcaaaaggctgtgctcccaagttatcctagccataacatgttctgatttcttactttcacattaaactctgtatagtatattgtagaacttaattcatatctgctaaattaaatgagtgaatacataaaacggaaaactgaggtaaattgtgtactacttacactaaatcaaagtacagccttaaaggaatatacatttaataatgagttttattaaataaaaataatgtattctaaacaattgtctgcatttaaaacttgccaatggaaccatgaaaaaatgcccaaactcatttttcattaatgcaattcaaagtaaatccacagctagaaacaattttatactcaacagagtagccaaaagttaagtttgacattgtcaagtgttagaatttgggagcaagcagaatttttaagttcgtgagaatttaaattggtgtaaccaattttaaaaataatttggcataatcttggaaacttagaaatacatcatgtcagtcagaatctaagcagacacaaaaagtcatttgatatttaaatcagaaagcttaaattatagaattgaaacaaatgagagaagaacagagttgacaagctgtggaggacaaagtgactcagagtttagcaaccacaggaagccactattacccttaaagtacagggagaggaagggagaggagagaagaagagtgggagagaaggggagagagagagagagagagagagagagaaggaggaggatggggaggaggaagaggagaaggaatggggaggaggaggaaagaagaaggcagggtgcatgaattcagtgaatgaggttatgagatcattcattggaagctgcagctatagtgggcctatctggttggaggggggacatcaaagcatatgcagctgttgccaaagatactgcctgaaacacaaagagaggaagagaagcactcttgtgtcttccctgagtttccaatccttcaccatcagccaaagagagctggaagtcacctggaaatggaagcctggcacacacagtctacaaaggtcagtctcccagtggtacacagtagagcagtgtaaaggagccaaagagtataccagagggcacatacatgggccctgtgacccagcaatcccactcctacatgtatacaaggaaccttgtttgtaataggaaaagaattaaaactggaaacgaccctagtatccatcaacagtagtatgcataaataaattgtgggttatttctatgacggaatatgacataatgctgcagtcacagacatggatgaatcttagcaacataatgctgattgaaagaaacagtcacagaagaataaatgcaatatgattccaactatacgaagttcaaaagcatgcagagcaagactatttctcttttagtaatacatatatatgtagcaagactataaaacaaagcaaatttcacgaccaccgttatctctggtggtagtggggaagcgatggaattggagatgggtacatagatggcttcaagttactgtggaaaattcgaagtaataaacacatttggttatgattgaaactgtatgtcttaaaatcttttgttcttatgtaataagatatttttaaaagacagatacatgtttaactgattggcaagttagtataacaacatcaacctaaaagaaattaagtttatttttgtttttgtttttgttttttaaatctgaaaagcatttccctttcagcttgctgggtttcttgcactaaaagatgagggtttaataatcatagcagatcagaggcttcagtagggaggagatgggatagcttattgtgaaaaacgattttccccctagtttaaaagtggcccctggtaacatttttcttgaagcttctagttatatatatcgttgtcagtcactttgcaactttgaagaaacagttttcctgccgaagggctctattatagttaatatgtgtctacataatacaaaaagtcatttaaaaattattgctttaagaactatttattgagtgcctcctaagtacataacatcaaactgtgaatttaaagtggacttgcataatttaatcaaaatttatactaaggaaaacaggctatagggcttttcgatactacaatacctgaaaaatgaaatactacagttataatccacatgataccaggtatgaaacattcagtagcagtgggctagagctacaggttaccttcttgagacacgttgtcaaagaagaccatagcactaggtaattgggaaatccagttggaactgtgtagcagacactgcccactctgttggtttacctctggcttgatcagccctgtaatggagagtctcgggcatgctaacagcccaccaggtcaagcacccactgcttctctgtgtttcagcctcacgactttgtccaaagttatagaaactcactcatccaacacacaggaggggacctgatgtccctgagaaataattaatgaggcacaggaaccagagacatattccccagcctcttattcttcagagggacaattatgagtacattctacagcattcctcagaggggtcttcacaggattgaacaacagtttcccactgcagtagccagctgaataatacactcactattgttttcccccgtttttccttacttcccctgcctcccacttgtgctccctgtgatcagctaccaaatgagctagttgctctctagtcctcgcctcaggcttagcttttaaagaaatccaaactaagacaaactgtgacaaattacaatccaaacgagattctttcctctcagggggatgcttagtccccccatcaagcatcattatcaaaatgaacacagactgcagaggaagaaaatatttgccttcactgagcaaagtcagactcatgaccctcaggttagagacacagagaaatgcaactaactctggggtgaataggtacagattcagagtggaaagactttaaaacagcaataaagtcctagaaataaaaaaagctgtcagctcggtacagaccagagcttgagagcaagagtactaagcgactcatagaaaaggattcaggagggaccagcacagcgactttaggctcatagtaacaagcaacagtttgctttggctaaagtttattactaggtgtggacaagcaagagataaatatcggaatctgtgggtacagcctttggatttcatgccatggcaaggtaaaatccatctgcaacatcaaaaacagagaggcatttgcaaaaggaaacatgaggagaatgttcctagcagcactgcccaaaataacacaataaacgaaaaatcttcgagcagcccaaatgccctctggcaggaaaatggacagttaacctgattacatagtagtcaaagaaacgactgctacacaaaacaatcaagataaattctagggatgggatgatgcatgaggaaaatatgagtcccaaatatctttttaataacatttaaatataaaaacaaactaaaacattttgtgtcatacagtaaatatttttaatgttctcacatatgttcacaatagccctatgacatatttactattattgtccccattttttttttggatgagaaaactgaggctcagagaacttcagtaacattcccaaggtcagatatccagtaattagtgtagacagaattcaaatccaggtggaaatgctctgaaacccacagtcttacctgctacactaaactggaacaaatattgttgaaacatatgtatctgataaaacatttaaaaatattacaggattataaattcaggcaatgtttactatcccaaagttggggggacatgggaagatggcatgaggaagctgtgctttatgtcattgccaactttctagtccttcagttggtggttaagtggagataaggatgaggccagagaacatgagtggcacgaatgcaagattacatcttgtattctcttaaaattttaatattttgctcatatgaattattttgcattgattttaattgttaaaatgaggtaaaatataatttatcctgatttctgaatttttaggcgaccgcttacattttgtgattcagacatagccatcttttctgggagaggaaggggaggaggtacacacaggatttgtcttgaatgtaggtttccctattttcagagattgtatatttgcttcctgtggcttggtgtgaggtctgatgaatgttaagcgaaggctaaatcaccccctctctccttagtaccaccactgaagtcacttctttctggccttaagttcaaaaggggaaactgaatgatgagtattgagcatctacactgtgtcatggcattagtaattgttcctcacttgactccctcagtagctacataaagtaagtcttcttattctcatttcatggagtaagtattcttattcccattatgtggaagaataatacttaaagtattcttattcatgtattaaaaactgaggctcagaaatactaagaacattgtctaagggcaaatatttcaagtgccataaattcttaaacttcatgggtattttgtatgatttttcttttcaacctcttttgactgggctattctgggaggtggtcacagctattagggccaaatgaattaaaatatatgaaaatgattgatgaactgtaaggcatcatatcaacataaatatagtataattaataatgtcaataataaaatcatttacttctacttctagtattcagaagagaggtaaaggtatattttgcctattttagagtaccatatgaaatgaaataaaatattattatgaagaaaaatttactcttttcacattgggaaactatccatcagagtcaacaatcattgtcctccttctctccaaaatagaacatgctgaggtttatgctatatttttgaactatttctattaacacaattaaaatgctgaaatgaatttgaaaagatgtttatattctgacgaagggtaactagaaatattttctactctaaattgagtcaggtgtgatactgtaaacaggataagtaaaaatataatataaaatttcaaaatttactacttgattccaatgtccagaaaagaatgaaaatataaatcatataaaactctagccaatttaagcaactgtaatccctttagacatcattaaatttactttacctctgacagtaggtgataccataaatgagtaagaacatattttaaatgtcaatatattgtctctctggataatatatttgatggttttatataccttactaaaacccatagaaactttttaaagatgtgatattagtgttgatatctattgaagatataattggctaaagtttaaaaaagagtaaaatatttttttccaagcacagcccagtaatattggacatgtgatctttgttttttactgttgtcataagcatatagaaagacaatttagcaagtgttctgatgaggtttaaagagcattttttctagtatatggtagtataataaacaataattcattgtatatttcaaaatagctagaagagaataattataatgatcccatcacaaagaaaggaaggattgagatgatggatatcccaattactctgatttgatcatttatacagtatatacatgattaaaatattacatgtgatatactttggctctgtgtccccacccaaatctaatgccaaatagtaatctccttgtgtcaggggagggacctggtgggagatgactggatcatgggagcagatttccctcagacttttcttgtgatagtgagtgagttctcacgagatctgatggtttaaaagtgtggcacttcccccccccccacatcccccagctcctgccaccatgtaagatgtgccttgcctccccttcaccttctgccaagattgtcagcgtcctgaggcctccccagtcatgtggaactttgagtcaattaaacctcttttctttataaatcacccagtctcaggtagttctttatagctgtgtaaaaatgaactaatacaacatgtaacacgaaaatatgtacaactatgatatatcaaaagctacaaactatttttgtttgctcatttactatatatcttagatattttggaaccaccaccaccacacatcacacacaaattcacaaacataacatgttataaaacataggaaatcaaatgagaacatttcctaaggctatgctttttcaactggtagttggggaggaaactgaatttcaaaatctccgctctataatttctctctaactctatattgtcacttctggggaaaaaaagagaagaaggtaaattgcatcttctggctctattcagaagaagaaaaaatggttggtgatctttgttgtatggattttatctgatgggtctcctagtttacacttagatttgctgaataaatcctcctcatttccagaaagacaatatggctttgtgggagtgctgaaggcacatctttgtcagttcccactatcggagactcccagtacatcctgtcatgccaggatttgctctgcctgacaagaaggaagaagcttatgatagctttctgaatgactctgaaaaatgaagctgctctgcaggtatcatcactagaccacagataaactcaataacattcatctgctagaaaaaaaaaaaaaaagaaagaaaagggttcacttccagatcagcctttggtagagataggcagtagggacttggcagtccctagtcacattcaaatgaaggttcgacctattgtgctgaagtctaagacaaaggtgcttatttagatttcctattttatggctaaaatatatgtgactgtaggaatcctctgttggacatacgcatacacaccaacttatctattgcaagggtctatattattagtatgactgtatattaaataattttattatctgaaaaatttgagtgcattgaagataaaactgactcctgaaatctaagtcctatttaatcaaaacttgcttcaaaaccttcccaaagtttcaacatgtattattttttcgtgtgtgtgacaaggtcgcactctgtcgcccagatggtgcagtggtgtgatctcagttcactgcaacctctgcctcccgcctcaagtgaaacctcccacctcagcctcccaagtagctggaattacaggtgcccaccaccacacacagctaatttttgtgggttttgcagagatgaggtttcaccatgttgtccaggctggtctcgaactcctgggctcaagcgatctgcctgccttggcctcccaaagtgctggcattacaggcatgagccactgcacccggtcaacatgtattcttaaacagatttaaaatgctttcttcatagcattaaaaatgtttcacaataatttacatgagaactctatggaagcttaatatatttccagcataggatacacacaatgattcaatgtcctggcccttgaagtacacataattggaatgaggagaaggacatttggaaaataattaccatgcaatatgatacctgctattgtacaggttcttacaggtgctacagaagaatcaaaggaaagggagactaattccacctcagagaattaatgaaatgtatcacggcaaagatcagattttgtctgggtcccaaaggacgttcaaaagcttggtaggttgagaaagtgggaaacagcattccaggtctaaggagactgccttaaagtttaagtaggacagtcaaagagtggaggaaataagtcaaaataggaaaatgacaaaaaatagagaaccttgtaggccaggcttaggacttctaacttaagacaatggagatcatcaaagaccctttagatgactaagtctgagagcagtgtgtaaaaggattggcttgaaaagatcaaaatcaggaagtccagatagaattgagaagactatggcaaatagtgttggttgatgaaaaggcattgttggtattaatgggagattccagagatactatccaacctgttttatacttttttgatcaggttgcatgtctaagaacatccctaggaagtattacttttcactgcattattttttactattcaactataaagtaaatggatgcatgtaactgttgagcctttccttgcactcatgccataaatgtaagaacataaagctacaccttaaagttaccttttagctcttttattttttatgttttagtagtattcagtctattctactgaattcagtcccgatttgttatattttatttactcttcaaagaaagtttttcaaatgacaattgaaataaaagaagataccatttgttctgtagattatctacattccaattcctatttcctaggttccctattctaatcatctacttttctatattttcttcatcaccaaatacaggcagtcacaggcaagtgcaggagttaataatcattgataaattacatgttatatagactttgatattcaatttctctggagatatataactatatatacccttctttccctcagagggctttaaggaaactaaatccccaaaactaaaagcactgactcatggtttaaagggtaagttaaatctctctgtaaaggaaagcctaaatgtgatctttgcaaacataactggtgatcaatagccgaaagattaaagcagtacatatgcaaaaaggaagattgaaacttaacattttgtttattgatgtcattcttagatctcaattaatttaatttgatacatcaacctccgtcctcaatcaaacactagatggataaagataatcactattatgtaatagtcaatacgcccaggtgtctcctggcatatatgatctattgaaatacatatattattatattttaactaagaaacacagtatctaacccaagtattatgtacattttttaaacaattcacttccttgaaagttatgagttaccaatcatttttaataaatttctcccagctttacatttatctatcaattatatctgaacttcaaatacactctggatgcatttgtctcagagcaatgatggtgtctaagcttgcagtttctgtgtctgtgaaattcatttgcagtaaattgtgaataaataaatgcagtaaaaagcctaggctccttggagagtctacattctcctccctcccatctctttctctcttcttctctcctaccctctcatcctccatctgtccctttccctatccttcttatcacacatgggaaaaactcaattgaattaaattcagtctaccagaagtatacaattgaatttttgataaacacaccagaaattagatgtgtatgttcatttattccttccgcacatatttgttgaatgtttacttcatgccacactatggatcaagcagtgaagataaaacagtaaacaagacatgcaaggaaactactctcatggaacttccaatctattgtagggaatagcaaataaatgacaaaataacataatcacccaatataataagtgttattgaagaaataaacaagatgttcagatagaaagtacctaaaatagagagtccagggaaggagagagaactagtctggatttcatagtcaaagaaggtgtttttttggatgtgcaattaaacagatttgaaggatgaaaattattccatcatgcaaaataatagcacaagtttgtccaggaaagagcctttgcaaattccctgggatggaatagaggccttcattactgtttggaacttctctcttcaatctacctttgtagcctaaaaggcatttttaaatatggtcaagaatgttgaaactgtttttcttgatagtgtaaataaatgtatgaactactcaaacaattagctatagtgataaatcgaataagttggtaggtttgaatatgctggataacactgtttctgataccacctagagactggttcccatctgtcaactggttataaaacaattttggaaggaatattataacttgcaaagaaaacgaacagaattcagagaaaaagtaacaaaaattgctcttaaatatttgaaaatatgttcatcctcattcctgagtagataagtgcaaactaaaagacatagtttcatagtttttcaccaatcatattggcaaagatcaaaagtttggtagtatactgcgttttttatggtatgaggaaattgatgttctcataccttcctgacagatttgaactgatatacgtggccatgtgtatgactatgcgcatgtatgtacagcagatatctgaaagaatacacagaaaaccgcaatgccagcacccccagtaagagagaaggaggataactaggaggctagctaacataataggagaaacaattttctttatgcgttcttttttgtttacctctatgaattttgtactatgtgcaattaactaggtaattggagctttaagagcactttgggggtcattaacactaaaaatattttacatagaaataattataagcatattcatccaaccatttatttatttatccatgcacccatccatccattcatccatccatccgtttatctcttcatccatctcatgtttaatttgtataaacgtttatttatcccatagactctatgtatgtatggtacatgtaaggttatataagagatacaatgttaaataaggcagtttctactatccctaaatttacaatgaaggagaaaagctacctcatgattacagatatgaagggtttggtaaatgcatcaccaaggcttacacataagcagaaggagagggtgcagagagctaaaaggctcccccaaaggactgaaacttgaaaggaattctgcagataggtttgaaagccctgacatgatttttttttttttttactgtttcctattgcatattcttttgtccctttcaagtatgaaaattcttataatttccttcaatgtatactctctaagtaataaaaacaattgtattctcaaaagctaacaaacaagaaagcaagcaaacaaaagttcaggtatcacatttgcagtaatatacaagtgctttcattaaaattatgcttttatgtgtttacttagaggagtcttgagaaaatatttagacctaccccctaagctttagggaagtggtccccaacctttttagcaccagggactggtttcgtggaagacaattttttcacagacttgggctggggagatggtttgggaatgattcaagcacattacaacatttatcattaaattctcataaggagcacacaacctagatccctcgcatgcgcaggtcacaatagggttctcgctcctatgagaatgtaatgctgctgcttatctgacaggaggcagagctcaggcttgcccggggctcacttcctgctgttccccctggtttctaacaggtcacggaccgattggtctggggcccagggtttggggacccctgctttggggacccctgctttggggagaacagcataaaaaggcagcatttctgaaactgttctagatttttatttttctgtcagtaaaatggttgtagtattggtatataaatcttacactgtattgtagagtctcaataaagttactcactgaatgaatattttaaaaagttttcccttattaaattacaaaagtaaaataggagtactataacataatctacataaataccaaatatgaattgatatatttttcctatattttaacagaaattcttcttgagagaaacatagaattctatgtctcctatttatagacattaactgctacattttgcacaaccacttttaccgttagaaagagaactgtactttgatggttacatagcaccttttcctcatgtacaaaatactaatgctactaacaaaaataattttaagtgatcaaaatatgaaatgtaattatcaaaccccattatgaggatgaggttaagataaagtaaaatcatctttgtcagggtggggcgcagtggctcacacctgtaatctcaatactttgggaggccaaggcagggggatcacttgaggccaggagttcgagaccagcctggccattatagcgaaaccccatctctactaaaaatacaaaaattagatgggtgtggtggcacacccctgtaatcccagctactcggtaggctgaggtgggagaatcgcttaaccccgggagccagaggttgcagtgagccaagatcgcaccacttcactccagcctgggcaacagaagtgagatcttaaaaaaaaaacaaaaacaaaaacaaaaaatcaactttatctatgctttgctataggtgttaacgataattgcctattgtcctacatggatgattttattaatagtgattacataaaaaaatgaaaaactttctgtgtagtggtgatgtaaaaagatagttttcatcacatggatttgttatatttttaaaaagataattcttcataggtttttcagggattgtctggttttatttgtttaatgaaaaataaatgaggtaacgtctcattgtaaaataagagtttaaattttaattaggaaaagatacccaagacagaaatacatttaaaataagatagattatcacttttaattatagaaaatgaagctttccagaattatgtttaaatttatagatgcattaaaaactatcaagtttaaacatttaagtacctgaataatgttgagcaaatagcaactttggactatgctggcatgaggagagtgaggaaatgccacgataaaaatcagaaattattaaagaagtccttgctttcttttgcttacaaaagattctattgatattgaaaaacaaaccaaaacaaacaaaaaaatggctacggcatctggattcaaaatgtttccataagtctatggatgcaaagtgagtctcaattttatgaaataagaaaaaagaaaaatgttagctagaccaggcatgatggatcacacttgtaatcccagcactttgggaggctgaggcgggaggattgcttgaggccaggagttctagaccagcttgggaaacatagcaagaccctgtctccacgaaaaataaaaagaaaattagcagggcgtggtgtgcacttgtcccagctactcaggaggtgcaggtgggagaatcatctgagcccaggaattcaaggttagagtgagctatgatcatgccactgcacttcagcctgggtgccagagagagatcttgtcccttaaagataaaaataaaaaataaatattagctaacctactagttttacctgagttccttcagtggattacaacatatttcaaaccacagccctattgaagttaatttctgtgtgatggaatttattagctttatgttttaaaatacactgattttctcctctgaaagagtgagaaaatattctttagaaacagtttacattacaaactctgatgagtggatatgaatactttgccaatgaaatgtgtgtggatacttggaaattggctgggacatgaataaattgctcaaccctattactgtacacactgaagtactattttttagtacttcagcagtaggtcagcagtagaatcctcatatccccaaagaaagaacattataaatatatgtgtaaatttttagcataaaacgtgtttaaaataaaatattaagatggaatattaagtataacctgaatattaagaacagatacactcggaattagtggggttggggaaaaagtagaagacagctctgtggccgatggttttggtaataatgtttagggattccaggaatatgattttcaatgtcatagtatttttccaaatgactaagtaggtttttcaaaaactctgggtttttttttttttttttttttttttttttagaaaaataattgatggactcaatctgaaagttattttggcctaccatacaaagcctatgcagttctcagtatgtgacctgctggaatgagtgtgaccacctcagtagatactaacgttgtactggcaatacttttaagtttaaaaccacaacattgtattccggaagacttctattttgagtcttttcattctgatagtatcctccaaggaactttaaagaatagaacccctgattcaggtaacaagatctgaatgtttgggatgcatcagtgagtagaagcaattcacgcactttcagaagtccttaacttttgggcccctcaagtaactggactgtaacttgaatccagtaaatgaactacatgaaactgtcaccaaactaaagcaattgatgaaacagtaacacgaataaatataaaaggcactgctaaaaaggctttaagaaaggctttttaacatttttgagggaaatagtatgtaaaagtgtagtacatgataactaaaattagttaaattaattgcaggagttactttaatcaccacatgtctacataacaatctaaactactaaacgttataatcttcaagaaaaggctacaactatgaaaaagagcattggtgaatgtattaagtttgatagtaaaaacaaaacagacaaattaagctgatttggccattgattaacttttggatattgggggacataaatatttatggcttgttttctatatctttaaattgagtatggatccagcaatcccattactgagtatgtatcccaaagaaatgaaatcattatattgaaaagatatgtgcactcccgtgttcattgcagcattgttcacaatagccaaggtatggattcaacctaaatgtccatcaacaaatgaatggataatgaaaatgtggtcacacacacacacaatggaatataattcagacatgaaagaagaaaatctaccatttgtgacaacatggataatcctggaggaagttttgctaagtgcaataagccaggcacagaaagccaaataacatatgatctcgcttattataggtggtatctaaaaagttgggctcatagaagtagagagtagaatagtggttaccagagactgggaggagggtgtgaggcttgcagagatattgatcaaagaatacaaaatttcatttagacaggagaaataagttcgagagatctattgtacatgttgattctacaggtggttcataacaatgtattatactcttgaaaattgctaagagagtagattttaagtgtttttcacttggctgggtgcagtggctcacgcctgtaatcccagtactttgggaggcggaagcgggcggattgcctgagctcaggagttcctgaccagcctgggcaacatagtgaaaccccgtctctactaaaacacacaaaaaattagcaggatgtggcggcgtgaggctgtagtcccagctactcaggaggctgaggcaggagaatcgcttgaacctgtgaggcagaagttgcagtgaaccgagatcaagccactgcactcctgcctgggagacggagcaagactccatctccaaaaaaaaaaaaaaaaagtgttcttcctacaaaaaaataagcatgtgaggtaataaatatgttaattagcttgactgagccattcatatatatatattcaaaacaacatgttgaatgaaataaagataaacaattttttctatccattaaaattaactatttaatttaaataaaataaaatggatttgatcatcctaacacatttactaggttgttataagatctaaacatggcatcatctgcagaggtcttggcttaatgtctgacatatattaattgcttagcaaatcgtagctgtaatcactaaataaataaatttattgacttttttattccatagtacccttcgctacattatttgtatctctacttcgtctactgggaaggtatgcctgtggcagaaaagtttccatcttatctagcctttctcacattcccttctgtccaaatcattccagcccactctgaatctaacttgttttgacagagtacttatttacttggcacatgataggttcttaataaatatttgtttattgccttataggaagaaagttatgaaggaaatataacttgtttactgaggggtagcaagtttccttctttctttcttttttttttttttttttttttttgatggaatttcactcttgttgcccaggctggagtatgatggccagatctcagctcaccacaacctccgccttttagtggagatgatgtttctccatgttggtcaggctggtcttgaactcccggcctcaggtgacccgctgcctcggacgcccggccgcaagtctttcttttatcttactaaacacagacaaatgatggagaaaaagtctgttaagcaaatgcatactgtcttggattatttaagttttcgggtatttaggttgatttcccaactaggatatcctggaaacagatttaatgtaaatcatcttatcccttcaatctttagattctgtattaatctttctaaaaatttgctcttatgttcttctggaacatttatatccctaatagggatggtaaatctgataatctgatattcaaggtagcatggtgcacacacggattatttgatttagaaaaaaaatagacatgtgtttccctaaccgcttgtaaaatgcagcatgtatataaatcatctcatgtattaggcagtttccattttcccaaaagaaaatatgcctgtgagccctcaaaaatattttaggccaacatgtatacacaaaattttaggactttagcaaatatatataatcaattgtatgcatgattttgataagaaattgatgccattaattttctatgataaaaatattaaatatttttatatttcatatttatatcatataaaacattagaaatattagaaatgctggcatgttttttagtctcgcatttcatgaaatgactttattcgatctctttgaaagctactttgaggtaatttttttctttgtcataagaacccctttttttaatgtcatctagaagcttttttcagaacccatcaactccatttccagctacataagttgagataaattactttgtgaatatgtatgctcttcgtcataaaaatttgacctcacgccacactctgcttgctagtaagaaagctgttgtttatatttttccccttgtcttttggtgtatatttgtgaattcaatagcatgactgcttactgttttgtatatgtggatacgtaggtatgtgtgattttttaaattatcattaacaatgacacctagcaagtaagaagatgaagtcagatacctgggaataatctaacattcaatatttgccttcagtttttcaatccgtttcatcaggtaacctacttacagatgtaaaacttgcaatgatttgtcttctaaacagtattatcttattcagagtaaagcaattgagagttctttctaaaataagagatttttaaaatataattaagcaactttgaacaaattcacctataaggagacgtaccagttataacactgttaacttacatggggttggggtaattgcttacaatcagatattctcagacattacaaactttaggttgcagtactacaaacaaatataatgaaaacggtgaataaacatttgtttatgcatggctttattcttttgttcaccaattccttgttctgtttaaacacattccaaaaacatttacccataacgtaaaggaaggtatgcatagatataatttcaaacattagtcaatagcattcagtgactgaatggatttcgggatggagaaaggaatacaaaaataagcgacttcagggatttcagatataggagcctggaagcagtggtgcttaatagaaaggggaaagagtcatgaagagctggtttatgtgggagtagataatgagttccatttggtatatttaattttgagactgatggggggacacttaattggagacgttctgtaggtgtaattatattaagaaggggaaaaattcaattagagctccaccaaattatatcagctgtgtccaaaccatattgattgcctgtgtgtatagctggtgtgcagtgtagcagagctgaatgctactaagctcccttccgttctacgttttttgatttgaagaagaatatggagggtgacatgctggaaagaggacatgaccagcagctttctctctctctctctctctcactgttcctctggtttctcctttgtttcctctactgcaaatggataatactgtgccatgttcaactaattggccatagttactgaggatatcaaaacccatcaagcacagatacttttcttttatattattattatattttaagttctgggatacatgtgcagaacgtgcaggtttgttacataggtatgcacgtgctatggtggactgctgcacccatcaacccgtcatctacattaggtatttctcctaatgctatccctccctttgccccccaccccctgacaggcccaggtgtgtgatgttcccttccctgtgtccatgtgttcttgttgttcaactcccacttataagacagaacatgtggtatttggttttctgttcctgttttagtttgctgagaatgatggtttccagcttcatccatgtccctgcaaaggacataaactcataattttttatggctgcacagtattccatggtgtatatgtgccacattttctttatccagtctatctttgatgggcatttcaacttacaatgaagttacatgctgatatacccatcatagtttggaaattttgaaacttgaaaatgcatttgatacacctaacagactgtacatcataggttagcctagcctatcttaaacatgcttagaacacttacgttagcctacagttgggaaaaaaatcataaaacacaaagcctattttataataaaatgttgaatatttcatgtaatttattaaatactatactgaaagtcaaaaccagaatagttgtataggtcctcaaagtatggtttccacagcatgagtatcactttcgcaccatcctaaagtcgaaaaattgttaagttgaactactgtatgtcggggaccatctctgtacttgaaagtagtcagaaaaccaaaaaagtaataaaaatatatgatacggtattattattattattattaggtctagtattctacttagagaaagaggaacttccactaagtatctggattaaaagaagcttttgttatttatacaactaaaacgttgtagaaattatttcccaactaatcaagacgcttttaaatgccttcacaatctaatcataacctgcttttctagccctatttttggtatttcacccaagcattcaagatttcagaaacatatagctacccattgtccttcccagatactatgaaattacattcctttaagcttttgtacatgttggtccctccctcctggaatgcaacccctactcctccataaccccaattcttcatttgataaatctttacatgctttgagatttatctcaaatattaccccattcctcctaccctaagcaaaaccattcatttcttttgcattatatatatttactattgcatacacaaaatgctacattctctatgacacactatactaggttgtgaactcatcaagtgcactattttttaatttttccattctttacacctaactcaagtctatgcatatatttttctattatatgattcatatattatatattatacatttattatatatattattttatactatattaatacatattaacaattaatactatatatatttcatatatgttaaattatgcattttatcttattacatattatatatattcatatgattcatatattatatggattcatataggtttgttaaattaacagtgaaagccccagtttttgaggaaattgtatgtattgcctatatcttggcagtcaactttactaataagctgctataaaataaatatgattcattaagagtgtaaatggaatcctaataaggagataaccctaaatttacgatagtcaggcatgttgtgcaacagagaaactgtattctgtaattgctagggggagagtgcgtggttactgtcgatagttgcgttatttagatcattacattgcataagtaatgtatgcccatattgatgtaaacgttatgcaggtaatgcatatttattacaaataaattagaaaatagagtaactgtgttattctgatttgctgaatcttttgttcacatgtaggctgaggtataaatcaacagaataaaagtgtttttatggctaaggtcagtgagagattcaaacaaacgtataagcatataagtgtgcttatataagtatgtattcatagtcacacacatatactcacatgctaacgtatcaattgatttaaagttaattttatagggggttgatttgtcacattatcaaacactaaagaatgtatgagtttttaaaatgtccatgagtgaagaccaaatgccagctaactgagtgtaacatagaatataggtatattgaaagtattcatatcaacttatatttcatcataaagctgtatttcattttaaggtttgaaactccaatatctactgtgtcaaagcagattgagtatataaaggaaatgggttcagtggtagctatgacaaattaaattttgcctgcttctgtaaagtggaaagtccctattcagaaccagacaattgttactagaactaaaatgagggtctagaaaatctattcaaatatacacacacgcattatgctaaacacaaacgtatctgtccttatcaagtaaaaataatgagcaaacatctgtgcatgaatgtaagctcagtctactttatcagggctatttccgattttggctgatagatcagtttccttattgatatggctacaatagaatccatttgaatgagattttgtaaccataaggaattgtattttgtaaggtggggtcacaaatcctttcctgtttcaaactgattaacactgatactgctcttttgtgaaaattgcctgtgtgcaggaccatatttgaaaatttgaacaataaataataagcatatgtaataaaagtaatagcgatgtgtgtcatattatatatagtttccgtactcccctagtggggtgggtggattttattttcaggggaacttccaaccttataaacaattcaccaatacattttccatctatggggtaaaaatgcaataggttatagccatatagtttacgccagacctctaaggcatttggaataaaggtagaaaaaaagggcaacatttaatatttgaataaatatcataagggtgaagaaaggagagtcgtgggtacatattgagagaaaagtaattataaattggtatgactagaagagaatggcaatgagctttggcaaatgatccccattatagtgtagtttaaacgattgatgtacaagcccgaaaaggctggagaatatcagatctgctggttacagggtgtatctgactaccagtttcagggtacagctgaaataaatcagtgatcccagaaaagaagtttctttttacgtgcaaaacttctgagcaaagtgatctctgccagctggagctggggattcacagcctctatttttccatcaaaagaattaagttgactcccagatagagaataactatatattttttttcagatgtagcctcctgagtactcaaaaccatctccaggatatggaaaattcaccttatccaaacgtatatggctaaaattcctttgtaaggcactacctatttccctgtttcttgtatttgattagagataactattgagaaaacatggtttatgaaagaaatgggaaaatattttcccgttttgataagaatgtatttttaaaaaacaaatggaaacctaaagacacaaaaaaatatttgtaaaggggataataccctgagggaagggagccagaagtagagactagagatattaagaaaaactttaatgaatttatattttggctcagagctcacctactaagggagtaaacaggcaaagtcacaaaggtttataatccttacacttgccattggtcggggtaggtgattagatgtgaaaaaaaatgatgctttatttattctgggcatattaaactgaactgggtgatttaaatgaactgtaggaaattcaatgcaacagctaaaatgaatgactaaggagctagaagatcttaatctgtataaagctgaaagaacaaaatatgcacaatttagctctgtgctaatgaaaggaaagagataacactaaaaataactgaatggtgcaggcttcaaggcagcagaagagttctggcacaaatggatctatccagaaaaaaatgagacttaattacacaaaggaaaaactgttgactgtgaggaaaagtgtcccaagatgaaatgactgctgttgaatgggaaaccatcagagaggcagtgacgagagtgttatctcgacaactgaagcagctgaaatgagacacgttgccggaaaagccattacagactaaataccccctggtcctaaagagatagatgcacatcaacttaaggagaattgcagagcaggcacaccactagaacacggggcagtgagtcaggagtagggtctttatctcaatgccattaggtgtagtcttgctcaacctaatttatttctgcggcttggattgctttctgactattctgcttcagtggaatgtcgttgtgaccaattttgttgctactaaaatacttaagtaacaaaatccacttcttgataaagatttaatgtcatctaatccctaagagttaaggacattacaaagattatcagtgaatcaatgaatattggtagtcatcatcaaaaaacaataggttgagagtttcagtaaaactaatgaaaaccatatataagaacattataaatatgattacaatagatgcatctcttttagaaacaaggtaataaacactgtgcttccaagatgtatttaagaatgttgaaggaagtgaggcacactgacttgtgcctataatccccctgggaggctgaggtgggagggttacctgaggccaggagttagagatcagcctgggcaacaaagagagaccatatctttaaaagaattttgttttagttagccaggtgaagtggcacccacctgtaatcccagctattcaggaggattgcttgaacctaggggttcaagcctgggtgacagagaaataccgcatctctaaaaacaattttaaatttaaaaatagaaaaaagcatgctacactgggccccaagatctatgcttgcctccaatttttccccaatttttatgatttccctttgtgtaatgtgatatttgatgcataaaagaatatatgtaatggatatgtaaattacaaagctcaataataaaacaaacatatgtccatcccaataactgaaatattagcaacaactcacacctgaacctatgtgctcctacactagttcttcactcttttgtacccctccctccatttacccaggattaactaccatccagaatctggggattgtcatatcattgcctttgatttcttttgtttgctcatttgttttgtgttggttttttcgatttatcacacatgcatgtatgccaaaacaatattttcattaggtgttcctatgcttgagctttctggagtgttgtctaatacaagggtcagcacactaccgcccatgggctccccggctctggagtgagtgcacttccccaggctggagcgcagtggcgcgatctcggctcactgcaagctccgcctcccgggttcacgccattctcctgcctcagcctcccgagtagctgggactacaggcgcccgccaccacgccccgctaatttcttgtatttttagtagagacggggtttcaccgtgttagccaggatggtctcgatctgctgacctcatgatccgcccatctcggcctcccaaagtgctgggattacaggcgtgagccaccgcgcccggcctccctgacagtttttaaaaatgaagttttattagactcactcacacctattcactcatataataactatggctgctttgatgccacaacaacatagttaggtatttgcaatatgacctagaagcctgaaatatgtactatctggccctttaagaaaatgtttgtggacctctacattatgtttttatgattttctcatattcttacatgtgatcatagttaattatttatactgctatataatattccatggtatgaccataatacaattatttgctattatgaacactgtagctacgaatgtccttccctccctctctggcactggagacactcagtgtaaattgatttcctaaattaattctttaatcctttttgcgctgaatatagaagtcacaaagtcacacaaacattaaagaatatttggaaataagagtagagtacagaaaatgcaaggaaaaaaaaacaattctatctctcccccttagacaaccggtaatactaatgttatgcctttttcctcttgctgtgaaactccttatccattaacagctaaggaaggatcactgtcgcctcaccttcctttttcatcctgcctattatgaataatccataaatctcattttaatgatttcactagaaagcattaaatgtaaataatccgtgggggtggacataggaggtaatattagacgagcaaaaggaagaggcaagatttaaaagaccttattaagcttttaaaatgttttagcacatgtattctgttcttaatatttcacacacacaaaaaaaactgtctagaaaccacaggtgatttcataactttacttgtatctcttttttttttttctggagacggagttttgctcttgttgcccaggctggagtgcaatggcgccatctcagctcaccacaacctccgcctcctgggttcaagagattctcctgcctcagactccggagtagctggggttacaggcatgcaccaccacgcctggctaattttgtatttttagtagagatgggctttttccactttggtcaggctggtctcgaactcctgacctcaggtgatctgcctgcctcggcctcccaaagtgttgggatttacaggcgtgagccaccgcgcccagcttacttgtatctcttaatcccatcataaaggggcatatcctattactttaaaagccaacaattccctctcattttcattcaccatgagttactactactcctgaaaccttcacaaagtttcccagaaacaggacagcccactcctagcccatgggcctcttcccttcctcatttcttacccttttcttcctccctgctttttttcttgaaataaaatttccccaaaagctagtctgccactgcaagcacatcctcagataactggataaaggaagataatgtggcacagaggagtctggggatacttctagccaaatagtttttgtgccataataatctttatgacagtaggatcctgaaatgttacctagaacacttgtgcctagtcccaatttctggtgggataaaactgtatataagggaatcattacaggtgcttgcgtctgagacacttctggctatgattgagtctcctacacattatcaaaaaacgtgtaatgctttaataacaaaagtaaatgaaaatcctcaaaggagttaatatgctaatgtacatagtcactttataagagggtagtgtaagcaaattatcccacattaactcaatcagagtcccggtagaaactggaggattgatttctcaatctcggggtatgtgaggccagtttgctaaaggggttatcaacagagatatgctcagtgttaggaaattcaagaagggatgacggagagttaactgtagacctcaagggttaagaggaaggacgtttcctgaactagagagccagacccaatagaaatgcaagagagaactgtccagcagaagctctggtctaatgttagctgttcagagctaacctgtggaaatcccatggggccacatgaaaataaatactccacccttttcttatccactgtactcctcctgctgcagcctgtctcaactggaaactgtagggcaaaggaactctgatgccattcctaaagggcagtccccaggacacaaagcacagtggtaaagaatgaaaaatggatttgaaaggacaagagggaaagaatttatgcactaagcataacttttccctttcaagttaatctagtatgttgagttggtttgctctttaactaaacccccctgtttccaaagcctgaggataacatactacctactgagttggtaaacaaccttaaggcagcagtcctggagcctagacagagacattggatgagtagacgaatggaggtacacgaggtatacatggatggatgcatggatggataggtgaatggatggatgaagtcaatcacattagtattttacagacacacgttacacaacctgtatctgaacacgatgagtctctcttcctcctttgattatggaagttaagagcaagcactgaggtaaccaatattatatagatttctggagtaaaacaggtactcatcatgactatcaacgatttgaatttggggatgatgtcaattattcaaagaacctgaaaaaagtagtgaagttgcttatctgaggccccagaacttccttcattttactctggctttcaacgttggatacacattaaaattatctaggaaacttttcaaactgagatgctcggattacagaccacttaagtcagactctgtggaaatagaacgcagatatcactgtttgtaaacactccaccaatgtgtagcaaaatgcgaaaactactgatctttccactctctttaagatctaccattatgagccccaaaatcattctggttctcttggtaatttacattttttaaaggaaactctaagatgccttgctgataatattatatatgaaaagggttatcgaatttatcgggtttggggttgggggaaataatacttatcaaaggagtaaaaatatgagcagttcataaaataacctgtgatagtccagattacttgcatattttcccttgcatttcagagtccttatcagtattcaaaggactgtagagcttttagaaatgcttcagtgaggaacactttatactctgtccctgataaatgaaagtgtttatttcctctcagataagtcagtaacaagcaagtattttctagcaactggactatacccacctattcatttcccaaggctcattgggcatcactaggaatacaacaggttttagttactaccaaccccagttactgtagaattaggcaattatataagagtttaaaaaatcagtaaggatgtttttattttaaactacttggataattgaaaagtaggtagacaacatttattttttgtctttatttgccaaacgactgtattagatttaaaaccagaaaacaagcccctatgtagaatatagattctcaccagttcatagatcaagtaataagacatttcctagggtgtttaattgtttgatactaagagcaataaattataggaaaataatttgtaataattggttaagtaattaaccacaattaagaaaagatgatggaatccctgaggatatccgacaatactgacaacattataaactttaagagaaaaaaaatagttgttgcagagcaagaaaagtcatcatgtgcctagcacaaatagaggtctaattataggggattttacgtttttcataatgtctacaatgagcatatactacatttataatcacgaacagtccattagcaggtatcatatatctgagttgggaaataccctgtcacttcgctaatacttctttctttttgttctaatagtgtattcaccaaataatcttctaaatatatatgtgtatatatatatatttgagatatatatgtatatatatttgagatatatatgtatatatatgtgtatatacgtgtatatatatatttgagatatatatatgcaggaagaagtgagtgacattctaagaaacactaatgaccaaaaaaccacataatatcttttcttagtggtgttccttccttatattggccaaccaccttgcaataaaaaatgatgatgtagacagaaaggaaaagttagagctacctattctttttcctttccttttagtccctccttacacgtcagtaagccaaagggcatcttcttgataaactgtacatttatgaagaaaggaaataaaaaccattaagttcattttatgcagcatttccactattctggtaagtaaagaaagcatgtgtgtggatgatgtatgaaatacaaattgtgtaatttctatgactctccatataagttaaatattctcatatatccatctaaaaatagcactgacttcagtaaagtttcaggaaacaaaatcaatatacaaaaatcagtaacatttctacataccagtaattttcaagctaagcaccaaatcaagtatgcaatcccatttataatagccataaaaaataaaagaggtgaatgatctctatgagaagacttacagaacactactaaaataaatcacagatgacacaaacaaatagaaaaactttccatactcatggattagaagaatcaatatcattaaaatggccatactacccaaagcaatctacgaattaaatgttattcctatcaaaccactaacatcatttttcacagaactggaaaaaagctatactaaaattcatatagaaccaaaaaggagcccaaaagtaatcctaaggaaaaagaacaaagccagaggcagcacattacccaacttcaaactatactataaggctacagcaaccgaatcagcatggtataacgtttcagttacatacaatgaataagttctggagatctaatgcacagcatagggactatagtcagtaatactgtattgtatacttgaaatttgctgagagtaaattgtaagttttcttaccacagacacaaaataactatgtgaagagatggatatgttaattagcttaactgtagtaatcagttcactgcgtatatgcacatcaaaacatcccattatacatcttaaatataggcaatttttataacatttaaataagagcaaaaacaaaaacaaaaacagcatggtactggcacaaaaacagacacataaaccaatggaacaaagtagagaacccagaaataaagccacacacctgcagccatatgattttcaacaaagttgacaaaaataagcaatgggaaaggactccctgttcaataaatggactggctagccatatgtggaagaatgaaactggatccctaattttcgacatgtataaaaattaacccaagatgattaaagatttaaatgtaagacctcaaactagaagaattgtagaagaaaacctaagaaacatcattctggacattggggttaggaaagcatttatgactaaatcctcaaaagcaattggagcaaaaccaaaaaattgacaagcgagacctaattaaactaaaaagcttctgcacagcaaaagaaactatcaacagagtaacagacaacctacggaacaggagaaaatcattacaaactacatatcacacaaaggttcaatatctagaatttacaaggaacttaaaaaactgaacaagcaaaatacaacgccatcaaaaaacaggcaaagggcatgaacagacacctctcaaaagaagacatacaagtagcctacaagcatatgaaaaaatgctgaataacattaattgtcagagaaatgcaaatcaaaaccacaatgagataccatcgcacaccagtcagaaaggccattattaaaaactcaaaaaacaacaaatgctggtgaagccgcagagaaaagggaatgcttatacactgttggtgggaatgtaaattagttcagccactgtggaaggcagtttggagatttcccaaagaatttaagacagaactaccattcaatccagcaatcccattactgaatatatatccaaaataaataaaattgttttaacataaagacacatgcattcacgtgttcatcacagcactattcacaatagcaaagacatggaattaacctagatacacatcattggtggactggataaagaaaatctaaatataccccatggaatactatgcagccataaaacagaatgaaatcatgtccttcgtagcaacacagatgcagctgtgatggaggccattatcctaggcgaattcatgcagcaacggaacgccaaataccacatgttctcacttgtaagtgggagctatatattgggtactcatggacataaaggtgaaaacgatagacactagggattactagaaggggaaggagggagggggataagggttgaaaaactgactattgggtactatactcagtacctgggtgacaggatcattcgtaccccaaacccctggaattcacttgcatgctccctcccataaggagttgaaaactggtctaggtaaatgaggcaaccctgtcacgagtcccgggaaggggtcagggaaataggctgcttcgatatcatacaactctctttttaaaaggtccttccaatatttcttccaacttgaagtccagctttacaacaagtttctggactctcttctttcctactctgcaggttatcagaaaataaaacaaacaaaaccgcaaactacaaaataacaaaaacacccaagcaatgtgattagttaagacattattaaagtgtgggtgtttccagagacgtttcccctttacaaaccatcctattctcttaccttttgagaagggagtgtgtgcgtgtctacgtgtacataagagagacagagaaagtgaaagagagggagatttggtagataaagactcaatagacttaggaatttcctatgtcgttatttgaatttgagagattactgagtgtaagaaaagataatccattttggctggagcagtggctcatgcctgtaatcccagcaatttgggaggccgaggcgggtggatcacctgaggtcaggagtttgagaccagcctggccaacatggtgaaaccccatctctactaaaaatacaaaaattagccaggtgtggcggtgtgtgcctataatcccagctagttgggaggctgaggcagaagaatcgcttcaatccaggaggcagaggctgcagtgagccgagatggcaccactgcactccagcctgggtgacagagtgagactctgtctcaaaaaacaaaaaaagaaaaaaaaagagaatccattttaacttgaatcttgaaattttctgtaaagtagcagaggtaaattgccatggaaatcataggaaaggaaatataagcccaacacggtaatagactctgcaatgaaatatatttatggtgctataataatagtgtacatactgtttatatgttttcaatttttagaataaatctttgacaaaacacgagacctaatcatagttagagaacacagaaggaatgcaactcaacataaaattaaaagtagactttacagaatttgggagaagaaattcagtaggagaagtgaagaaacatggaggaccactaaaatccccattttatcatgtgaagggttaagacatacttttgacactgttttgaagaaaaaaattaacatttaaggtcttcatgtaaaagaaaaattagttaatagaacaaatacatggggtagatataaatgagataatttttcatctctcataagagagactgtagaccatgaaaaaatgagaaaatcaagaattagagatataaacatgttattacagatttgtcacgcattagaaaaagagaatgactcaaatatctgcctctgaggagtgagaaatgagagaggaatgcagcatatttaaataaaagaacttatgaagtaaaaattacttgaatcatgtacagataatttgattaaaaattgaaaacattgattcaaacaaatttatattcattaataagcattgtacactttttaaaattccaataagaaaaaatgagagacttaaaattaggtaggaatgcatttcccagaggttaaaaatttatattttaatatatatgcatatataagcgggatcataatacagcattatatgtatacatactgtgtattacagtctgctttattttttcatgtatgtatttggattacctttaatatcaatgcaatcacctgtaaaattttattttaaatttcccttctttagagatatatcattttttagtagcctcctactgatgaatactggtgttgtttccatttttcactgtaataacaattaaacaataaatataggtacaactcagtctttgcacatagatgtaagcatttcttcgataatttccctggaaatgcaattgcttagtcaagtgtaagcacgctttctcttgattggtattgcaaactgctctcatgaaataaattgattcagtcttctgtcagaagcatacaaagtatacaaggaaaagttatttttattttcattatttggttacaaatgagatcgaacattttttcatatacctttggatgtgttttattttctttttgtccaaatatatggggtacatgtgtaattttgttacatgcatagattgtgtagtggtcaagttagggcttttagagcgtccctcacccaaatatatcatacacattaatttctcattatccactccactccaaccccctcaccctactaagtttccattgtctatcattccactctctgtgtacatgtgtacacattttttagcacacaattatgggtgaacatgcaatatttgactttctgtgtctggttcatttcacttaaaataatgacctccaggtctaacactttcttcctgtatgcttaaaattaggcaatgcatttatttttctgaattgatttgtaagattcaatttcagtttactggtttttaatgtacagattttaaaaattatctatgtgttttccattttaaattttgggtttttaaaatcatttctacatagttctctaccatcgcctcattgtagaaatattcacctatcgttcttcctgttctttgggcttcttaagcttaattatgattgaatatttgttcaaggtgaaatttaattcactgcattgtgtaaagcagggttttgccttttaacatgattatcaaaaccatttctttcatagtccatctctatccactgatttgaaattccatttttattatatacacttgagcatattttgggattttctcttttgtttcactaatctgtttgtatagacttttagtagattttttttttttttttatacagagtcttgctctgttgcccaggctggagtgcagtggcgaaatctcagctcactgcaacctctgcctccctggatcaagcgattctcctgccgcagcctcccgagtagctgggattacaggcgcctgccatcatgcccggctaatttttgtatttttaagtagaggctgggtttcacgatgttggttaggctggtctcgaactcctgacctcaggtgatccacccgcctcggcctcgcaaagtgctgggattacaggcgtgagacaccgcacccagccagtagaagttttattaaacactctaatagctacatgggcaaatgacctttcatttaaggttttcaacattttctattaatcctcatctatattgctgccagataaactttagagtaattcttgtcacatccaatgtcttcctgccaccccaatttaaattttatgtgtttctatcagattttagcttaatttgtagtaaattatatgtctaaaatattaatattcccaccaagaaatataaaattatatctgtccatggatgcaaatattctgttatttttccagtaaaggcttgtatatcaccaaatttcatgctaaataaattcacagtaatttcacattttgaacttctgtggaaaatgatagctttgattttcaataggttgttaaaagagaaattagcatttagaaaaattacatttaattaatatttaattatttctaggttttttcttttcttaatgagctttgggactaatttttcccattagttataatagttgtcattgttgatttacttagtaccaagttgacaatatcatctattaatatgaataatttgacttttttccccaatacttatacttcctgtttcttttacttggcttctttcactgactagaatatgcaaaatagcatttaaaaagagcagttttggtagtcattctagttatatttctaattttaatgaggataccttcaatatttcaacattgatcacagagttggctcttgttttgagatagacaatatttttcatgcttataaactatcatctattcttacattgctaaaagttttgtttctactcctaaattagggacagattcttttcatttatcaatactttttcataactaaaaagtattgtatattttttccttctgatctttacctacaatgaaggatgtaaatagattctcttatagtaggcatatatgttttcctgaaataaatccaatttggcatgataacttcttctcttattggctaaatctgctatgttttataagatttgaacgtctgtattcctgagattggttgatagttttcaatgtgtatgctatttttttgaagtctcataatcaagattataagggctttagaacatgaacatagaggtttaaatactattttcatggtttggaattttgtaaacagataattcatacttagttgtttgaaagcatttctcaatatagtatttttgaagttatttcttgtactgctttttaaaggtttcttacagaatcaaatgtttagttctcttattttccctttaatctcaaatataaaaaaattaaggctattaattttctttgattacagctttgttcttattccagaagttttcatgtgtattttccttattcattaatttttaaatggcctactttttttttggttcaaggaaagaacactactttttctctcctgttacaaaaacaatgtatgtttaccataaaaagatacaacaataactattaagaaaagtacagataactcattttttcattaagcagcaccactgctaacatcctgttgtctactctgagtgtttttctgtatatctgtctataaaaatctaacgtaaattcaatgtccgattcctgtattatctaaaaattatatcatatgatctactaatcatcttttcctatttgttttaaattgcttgctggttttgttacattacatttttttctagacattttataacaaaacagatatatcaaattaatcatattcaatgatgtgttgttgcaaacatatgtttatgaagtccctgcttcgttgacattttttttcttgttcatatggctggattttctttgaatttacgggcttttgtatgggagctgctatattgtttacaagttcaatggcttgcaacctttcctgtgcattatagtcacctggggagcttttaaacagcccagtgactaggttgccacctaaaccaattaaattagaaacttcccaggtgggacctaggcatctgtaagttttaaagactctcgtgatgttctaaatatcagcaaaggcagaggaccattgagcttgttagaatatttgggaaagggtgtttctaagattaaaacttaaggcttatgtatttcgtaaacgcagctgctttaacaaattagtaaacaagctaatcctagtatctctaaaaaacactagtttaattttgcctggagctgcagttctcaatatattgtccagcatatcctccatgcagggaaaccactgtatacaccaatacttatgagggaggatgatttttcaactgcaaatctttaattgccttttagaaaatccatccagttttccttaagcaagttttagaaagcacatacacgagcaattacaaatctggccttcagcctaactcaagaattaaaaaaataaaatctcaaagtgaagttgtattaattctttttttctccttacttttatttcataaaaatagacatctttatcataaaactggcttcttgacatcatttggggccactttccctctgaaagacaattctaattgcatttacttgttctcagaatcatacatttttttaaaaatgaaaatagtttgtacacgagttgccaaagaatggtctaattcagtgtcaggacaaagatggtctaattttgcattatttagtcatctaattaaaaacaaaactagtaataatttagccataaagctgttcattgaagaataaaagcaattgttaattaacttttcattgaggaaagtcatacatttttcatgttatcataacatttcaaaatgccctgggaaattacaaaattaaggtaatgtaaattattgatatattataactctaacaatgaaacattttacccaggcctctaatgaggattctcagttaaggggaggagcagaggaatgcataaacacatgggaggtggggtggagcggaaacccagcttccaggaagatgttttaggagaaaacagattcctaagctatttgaggtacaacagaccgaaggcaatgtgcagtgcaatttatttccctaaacttatctgttataaaactgaatccttaagctggttgtacaaagtcacacaactagtcagttaatgttctacaaatagctctttcagagatttttctactagacttgtcaccttatttaaaccttgaaaccccactcaaaattgacagtgagagaaacagacacacacacacacacacacacacacacacacacaccagggacggagggagagaaagtgtattaatagctaaaacccctcttggccttgggaaagaaactctctaccctctgttaataagaagtgagagagctgcctcctctttgaataaatcaggttctttagacaatgtagagttaagggctttactcatcaccctgttctctggatgccatgtaagctcaccagattcttgtgaaactacagagaatggattagacagtccaaaacataacagattgtacttgtgtttgctctggtaagtggagctttagtttgatgtagagaaataagaggaaccggcatttctttcacctggacattatgaaagagaggtatctgaatcatccaattaagtgagcaggaaatctggaatattgtaggtgttttacatgctcattctttctttctacctgcttaattgtatctgtgctatttctgttaaatgcatctgcggtgaactttgcagttgctaaggagagcgtttgccaattccatatgcctagtctaaggtaggctgaagctaatctgtcattctggagaagcaagagaagctaaggttttcataatatttagttgataagggatgagaactttagatacatgttatctcttactttgctatttttccaaaaatgtatttgaaacactgttaagcagagcaataatatttatgcagcattttacatttttaaagtcctttaaatattacatcatgcatcaaaaattatcgataccaagatgtgattgtctcaattttagagacgataaaattaaaaataagaggttctcaaaatgtcattattttataataactgaacaaaagttttacctcaacatttaacatcaaaaacattttcatttttattagatcatgatgttctgtttgctcgtcacataaaatattttaaagagatgtttggggtttaaacagattaagtatttctatagtgccttgaattaacaaataaaagtaaataatactaaaactacacccatctattgtcttgctatgaaacctagaggtaaagtgtatgtgaagtaaaacagtatttttgaagttgtaatgtcttaccattgcttcaattaaatcgttacatacacacacacacacacacacacacacacacacacacacacgcacacataatatattagatgatagatagattagataggtaggtaggtaggtagatagatagatagatagatagatagatagatagatagatagatagatagacagacagacagacagacagacagataggcatttgtgatccccactgaaaaaaactggcaagcttgcctaaaagtgaggagaattattaagaaatagtaaactacccaaggacattctgttcttttccttacacataaatatgaacgatggtgctcccctttggttccaactttctgtgtttcatcccctatcatgccaccattgtgttagtgtttcccatttctcctttacattcaaagtgttgcctgtcccatttaatattttaatctgaagaaatccttgggatgggaaacacaatggtaaagaatgaagaatcgctttttaaaaatactgatgattacaatgtattcttaacaagctttggatgaatttgtattagtcgcccaaacagttctaaaaaaaatcagcataacagcaaatttgacaacaatcaaaaactcatcctttctgaatatgtccctgaaagaaaagctcagcactgtatgcaactccatcatatggagcccagaacatctctttgtggatatgtgactaaaggcaaaataaacatccagtgtaaaggtgcagaggcaaaaaaaaaaaaaaaaatagagtggtctattggaggaaatacagatggactggtattgctagtagaacggtggtgaatgaagctagaactatagccatgaactagatttttagaaaccagtatcctatacttgggggttagatttcattatgtagacagtagttgtggcaacctatgggattaagtagggtccaaaaacaaatatgtagtagtagtagtagtagcagcagcagcagtagtaacagcaatgacaacatctaggatctattgagcacttaaaacaggccaaatactgttttaagctctttacttgtatcagctatttaattctcatagaaataagtatcattttatcatcattttacaggtgagtgatgaagtatcttgctacacattatggaggtagtaagtagcaaagctggaattcaaacagaaaccagtgtgcctttacactgcaccaccctgtatgcttagggagatcactctgttggcacattgcagggggagaaggacattggagactgtattcaccacggccatatattgtgtgatggtatatttcttggaaagcacaattcgggaacaccatagcagagaaggcaaatattatcagccttctttacaggttagaacatagactcagagtgtttaaattaattggccttacccttctgaatcttcatacactgcactttctacccatcagaattacttattcctatttcctaagatcagtcattccagaaaaaatgaactttcttctttttatgaattcagaaggaccggagacaggtaggcaagacgcatgaacacaaaagtgtcttaaaatctcagagatacattcatttgtgcactttcacttattcattcattcagtaatcatttatagagtcttttatgaaccatgtgctataagctaggtcccgggagtaaaaggcgggagtaagctgacaattaagttttcttttgtccattgaattttgtccaattcgcaggtggtacttggttggttgaacctcctaaagttaccttctagctcatgcccccaactatttgccactttacaaaaacgtcacacacaccataaactgagaaaatcatcagtccagggaggctcattccttctgcgatgaagaattcctatattgtcgcaatattcagctgacaagccatggggtaaaactactgtgagcatttcaacttctgattataccccaccattttttctgatggaatacagagagtggccaaaccagcagccttccttcaggccacatttccccagcccagaagttcctaaaatcttgtggaggcgattcagctttatatttgacagttatttatatttctggccctacagactctgtccgagcaaaagcttttctagacatataattttaaggggaaaatatcaatatttgaagaaaacaagtgtgctggaatgtccctctaccttatgattcatttgttattcctagggtgttctgcagcaggttaagtgggctattgaacaaagaaaaccccaggaattctgacatattctattaccttaaactgatcgaaaatcagcttttcttctgttgagatgaattacttgacagtcagtagaaaaattcttcccatgggtttctcctttctgaaacctttcccacccccagtcctcagaaatatactttggtgagtttcctctatcccaaagcattattcatataatccaagaaaaactgaaagagacttgaggactaatttgcaatgatctgaggtacctgaaatattttattcattttatttttatatttctttgaaataaatacacttactatcctaagggtaactctgatattaaaaagactcacatttattacatatataccagagcctatatccccaaatagaattatttatgagaaaccttaacgcaaataaagatactaagccctcggggcctcttgtgcttttatatttgacatctcctctttttaaatattcatgtagaatagccttaagtagaaacttgaagatgtgctagtataaaacattttcctgagccactttattgttgatggggtgttttctcaatctggatctcagtaagtctttcccttaaatgaaaaagggctatttctcaaaccatgtatgaatgccagcatttgttcagcttctttttttgtttgttttttttttttgagactcagtctcactctgtcgcccaggctggagtgcagtggcacaatcgcggttcactgcaacctctgcctcctgggttcaagcgattctcccgcctcagctccccgagtagctgggattacaagcatgtaccactgcacccggctaatttttgtatttttagtacagatgggatttcaccgcgttggtcaggctggtcttgaactcctgacctcatgatccgcccgcctctgcttcccaaagtgctgggattacaggcctgagccactgtgcccagccttgttcagctcctttagcttactttagagcagtcacaggttgccacttttccagcatcagggacaaagttcagatcaattttataacacgtcgattctaaaaatcacagtctcgtgggaggtggaatatctgtcacaactcataacatatttcctactgcttcatgttccatatattagaaacccattcaccactaatttccccaaatttacaagttaagagtttaaattatagttttataagtgaatttatctactttatttttcaggtcatggattctagctctcatatgaagtaaggtcttaatgctttttatttctttaccttatgttaaatttcagattgatgagctttctaataatattgaaagttcacattactaccttagtagagcttccaaattcaaattgaaatttcactgggctgggtgcggtggctcacacctgtaatcacagcattttggaaggccaagacgggcagatcacttgaggtcaggagttcaagaccagcctggccaacatggtgaagccccgtctctactaaaaatacaaaaaatagttgggtggcttggtgcatgcctgtaatcccagctactcgggaggctgaggcaggagaatcacttgaacccaggagatggaggttgtagtgagcagagatcgcgtcactgcactccagcctgggtgacagagcaagactccaccaaaaaaaaaaaaaaaaaagaagaagaaaagaaatttaagcgaagatgtgagtaactgtatcagaccagactcatttttatatgtaaaagatgaaatggcgttttctactcttaataaaggcaaagatgaactaatacataatgcaaaatgagcactggaagagatatacaagatgggtaagagcaaaactatcaatttttgtatttttcattcattcagcaaataattaccaagcaagtcatacatacgtaaaatagtctttatattttttgtcccatctctatgatagtgatgaaagtgaatgattctttaaaaaaatgataaatattaaatatcggctagatacaaaatattatcattggtgtatataaccagaatttaagttgaatcattggcatcaaagattttaaatagttcggaaaattaaaaaatacattgctagtccccacttacaaggagcttgagaagagaaaataaaaataccaacaaatcaatacagaaatattcactatagatcatgaaactcaatgacctgtaataaagtttaagaaaaacaattttatattgccttgatagaatagcccaaatcatcaaagcagatggaattttcaaagacagtatgctatcatgagaaagacatgtgcggaaactaggaagaagcttgtattctgaatgtgttaccaagaggttacaatgaatgtaataaaacatctttttgtggtaagaaatatggaaagacagtagctgttctactgcattaatctccttccaggttaacaggtgcagcagcagttggcttcagaaactcttgttaatgcgttcctcagactgtcccatctgcttcttattgtttgctccatacaaaggcatgttaatatgtctacctacatatcatcattgtttcattttattatttgctaactgaactgtgccaacatgatagaaaagaatcaagcttactataattttaagatactaagacacttactagtaaaaacaatgtttatcgaatttaagacctttgtggactcataacagagaactagttctgtgcaacaggttcctttcacctcaagccattcaatcaacattttaaaaattccaatacgattgctccaaggacctatgagagatactttggattcaaggacctcagagtcgagtggaaactctttctttaaatagaatgtgacccagaagcccaatatgaaacagatgaagagtgagctattcagctaaaggaatgctgatggtggtagtggtggtggtgggcatccactgtcttctcaccctacacatggcccttgaaacactactaaaacccactaaggctccagtgagactattgtaaaattcccatatattctccagttcctagtttgtccaccaaacctatccacagcttttctttgtttttaacttttaagttcaggggtacatgtgcatgtgtgttatataggtaaacttatgtcatggggatttgttgtacagattattttgtcatccagatataagcctactaaccatcagttatttttttttaatcctctccctcctcccaccctccaccctccaacaggtcccaatgtatgttattcccctctaagtgtccatgtgttttcatcatttagctcccacctgcaagtgagaagacacagtatttgattttctgttactgtattagtttgctaaggataatggcctccaactccatccatgttcctgcaaagtacatggtctcattctttcttatggctacgcagtataccatggtgtatatgtaccacatttgctttatccagtctatcattggtgggcatttaggttgattccacgtctttgctattgtgaatagtgctgcaatgaacatacgtgtgcatgtgcctttgtaatagaacgatttatattcctttgggtataaatgcagtaatgatattgctgggttgatggtatttctgtctgtaggtctttgaggaattgccacactgtcttccacaatggttgaactaatgtacagtcccaccaacaatgtatacgtgctcctttttccccacaaccgtgctagcatctactattttttgactttttattaatagccgtcctgactggtgtgagatggtatttcattgtggttttgatttgcatttctctaatgattagtgatgttgagcttttttcatatgcttgttggccgcatgtatgtcttcttttgagaagtgtctgttcatgccctttgcccacttttttagtagggtttttttttctcatagatttgtttaagttccttataaatgctggattttagacctttgtcggatgcatagtttgcaaacattttcttccattctgtagtttgtctgctcactctgttgatagtttcctttgctgtgcagaaactatttagtttaattagatgccatttttcaatttttgcttttgttgcaattgcttttggcatctttgtcatgaaacctttgtctgttcctatgtcctaaatggtattgcccgggttgtcttccagggtttttatagtttgaggttttatatttaagtctttaatctatcttgagttaatctttgtacatggtgtaaggaaggggtccagtttctatcttctgcatgtggctagccagttatcccagcaccacttattgaataggtagtcctttccccattgcttgtttttgtcagctttgttgaagatcagatggttgctaggtgtgcagtcttatttcttggttctctgttttgttccattgatccatgtgtctgttcttgtaccagtatcatgctgttttggccactgtagccctgtagtatagtttgaagtcaggtaatgtgatgcatccagcttttctctttttgcttagtattgccttggctacttgggctcttttttttggttccatgtgaactttgaaatagtttcttctagttctctgaagaatctcaatggtagtttaataggaatagcattgactctaataaattgcttaggattgccttggctacttgggctcttttattggttccatatgaactttaaaatagtttcttctagttctctgaagaatctcaatggtagtttaataggaatagcattgaatctaataaattgcgttgagcagtgtggccattttaatgatattgattcttcctatccatgaacatggaatgtttttccatttgtttctgtcatctctgatttctttgaggagtgtttggtagttctccacgtagagatctttcacccctctagttagctgtattcctaggtattttattctttctatggcagttgtgaatgtgattgcattactgatttctccctgttgcactgcatgcaacagatgcaatggaacagatttctctctgttgttggtgtataggaatgctagtgattttggcacattggttttgtatcctgagactttgctgaagttgtttatcagcacaagaagcttttgggctgagaccatggggttttctagatatagcatcatgttgtctgcaaacagagatagtttgacttcctctcttcctagttggaggcgctttatttctttctcttgcctgatttccctggtcaggacttctaatactatgttaaataggaatggtaagagagggcatccttgtcttgtgctggttttccatgggaacacagcattccttaaatagacatgaagcccctgcccacaccccagtgaaaaacaactcactacttccagattaagctttttatatttttggccatctctcactgttacaaagtttgtttgtttaaatatttagtggacaaagggctctctttcctttcttctcatcataataagaatatgcttcattgcatttccactgattagctgaatatttgaaaacagctaatacgtccctaaaattataagttgctttctagacaggctccagtttttcagtgtctcatttaaattatgttccccagagctgaacagtacagatttggtctgatgaacttacttttagtgtcaacaaagagggtgttctgggcaccatttcaattactatacttatttgtttttcttgtatctctatcataatgttaaagtcatcgtaaactcttgtttttttatttaatacttttgggtggagagaggggaatgctaacttaagaaattatattttccctattcaattttattttgatgtattaagcaactatttcagtgcctaatatgtgccaggcatgtgataaacagcaggatgcaaagtatacatagtctacatctacatggtgtatacatatagtcaaagaaatattataacagttaacatgtattggtaacttaagacatatgtatagaggaatctgaggcttggtttgtggtcaagatggtatatatataatccttggtttgtttgcttcttgagacaaatctagaaacaactaggccaaagtaaacactatcaactattataatagtcatgactcctttgagtatttattctttcttctggaactctgacagatattgtgatttaagggcgtagggataggaaaggaaaaaaatgaaagcaaagagacagtgagaacactttttagagccagggcacagcctaagatgaagaacaaatgaaagatctacatcagcagccaaaggtaaaaataagcacttcagaaagaaaactgattttccacagaagaaaaaatatggcagacataatgtctgatggcataggctccagatggaataagaaatacacagctgcagagtaaggctatcttcagttaatcgagagaagcctgatcatcagaagcattagccaatgtctgtaaacatataataataaaataaatgcagaaatcactataaatctttgtgttaattttgttttataaaaataattcaagaactgttattttggaaccattatatgtatatagtaaggtaattaccatataagcaattatactaatgtcattagaaacatagattttcagcgtaagagagaagagactgcagttaaaatcaaatatgttcgttcctaattcttgatccaagtggtgatctgagtggtagctatctgtgtttatggtatatggttatgttatgcttcaataacaaagtgtattaaaaatagaagaaaatgcaataaaagttttaaaaagcaaagggcaagaataaagataaatcgtttcttcaataaacagtgcttatcaatcactattgcacattttatttcacttaatttctcagaaaaaccttatttctattgaaaatctctgtatcttcaggcactggaaagactcccaccaatttaactgtaactcggatgttgatttcctaacacaagttcctcccattatttaatttacctaaggactatcagttaccttaatggaaaacccttccacttattatatctctaagttatctaacaatcatgtctcttaagaaaatatatatttttatctcaagtaatctcaagttaagattactacctttaactaaaatgtttatccattcaattaaaatttattaaagtcagctttgcaaatggtatttcttatttttcttcttcctttcatatgtgtacaaaatattaattcaacccagaagtgtttttcctccctaccagaaaggtaatcttattggttaatttattacctcattcacttaacttctacatgttacccagataaactattgtaaccagaacttacattattacgattgcaatatacattattaccaacctgctatttaggagaaaaaacacttcttagatatcataaatgcagctttaacatgcagaactgctttaaaacaggcatacaggaattttttggggggggatgaggggtgtgttatttttaatatgtctaaaggtaatacatttaatgaactatacaatatttataataagttattacaaatatgttcattttatgaatttttattttttcttaattatgaagtttgtaagtatattaggaaggtaataacttcacagcaatgtggcagacacagttgaatgtaacgtactcattaattttcaaaacaatcctatgagatatatactcttaagattccttttgtaaatgaatagactgaggcacaaagaaggtaaataatttgcctgagagcattcagtgcgcaaagtacaaggcacctaatttgaatttggcttcagaatccaactcttaatagctacattctgatgaccctagatccagggactcttctcatccaattccggttttgttgtgttttatgtaaaacacaccactgtgggttatcagattccaattttgttcattgtcttgaggattttatcatttacctgtaaactaaactgaattctgccatctcacccattttgccactcttactaaatactcaattgtttagttttccttcaatatcgggctacatctctccaaattgatgtttataattttttgccttccctcttgacttgacatcactgagaattaaaatctgactgcccaaatccttactgggactcctacaacctactgattctactgggacaacctacaaggttgtcttgtagctgtctttctcccccaggatttgaaaaagccttgcacactgaagcccaagaacttgatataaacttcaaaagacttaccaccacaacaaatcacgtataggcaaccttcatgcctggagctcctgctacaagagccattcagaaagtccactggaactccagcatcatccgtgttctgttccaggaaataactatgactgtgaaattaatgtttatgccatcaccacattcaaaccataaaccagaaaatccatcagattaccactctaccatctgaagatgcttagaattcaatgtctagaaaacttcttaactgcctgccctctagactcaacaaataggatttatattcttctccaacaagtttttgtttttatgtttgtttccatagaggtgcctctcattaaatgcctgatcacgtgcatcatccagcaactatgctctactagcaagtctcaaccgatgatttagctagtccttagtaaacaaaaggcaatcgaatgacaaatggacttacactgttcagaaggatgaataatgtgtcttctttacttgaacaggagtgaggctccaccaagacgctccccttgaccaaactttagctaggctcctctgagccctcttctcagctaggccataaccttggcctgcacagacctgaacaaaaaacactaacatagcttctaacaggtcaaagccacctctctaggataactctagccccacttaaggtgcatttctgagaaaactcaaagctgccaaaataatttaccctttgttccagtcaaaacccgaagacagtgagaaggcaggagcctaaccttaagtgccatttagcaaacgtagaggtttcccagggaacaatcccacctttccactttttgtaatttgttacttccctgactttaatgagccaccactcaaactcattctctcattctccctttaaaactcccagtcacctctacacaaatcaaagttcagttcagttcatgctgaactcttctctattataatagtgtattactgattaaaatctccccttactaattaaactgacgtccacttttgcttatctttggataactggttatttagttggtttagtttcagtttgtgaatgtcatgtggtctcaaaaggtcacatcatatagataaaaccgtgcacgccaacatcaatgaacatgtgaagaaggtaaacatgattattttattgcaccatttgtaaaaaaaaaaaaaaaaaaaaaaggtcaatttaaacgaagtactgcatgattacattgaacgtatttacgtatttgttgaatagtatttttcccttgtaaaattgtatatgttaattatacaaatgttggaatctacagaccatggaagcataaaatatatattgcctcccattctgagaaaatcctattgaaagataagttatgtcatcacagtttttctgtttttgtttcgttttggtatggcttggtttctggcttttgttgttattattttgtctatataggcaagtattcatttatttcctgcattagtcaagggtctctaaggaaatatttgattttatcaacagctgaagtaggaaagagtgcctggaatataatatccacttagaagttttttatggtatggttgattcacccattctatttaacctcagcattcaattactctcactgctatttttttttaaacctgaatcatacattttacatttaatatacactcattgcaaatacatttaaaaattctaataaggcagagcctttagaagaatgcttgactcagaaactcaataaatctttgttaactattgaaggaaattttaattaaataattaatattcataatcccactcaacaaaattactgatttttattaatagttttttcaatcacctgtatattttaattagcatactgtaaagaaagtaatcatttttcctttttaaaataaaaaacactatgttatactgactttatcactgagataatctcaagcagttattatgagctgcttttgagctatttgaaggtacagttttactgctatgtaatttccaggcctatgtacatctaggcataagattttctcagctgttaaagctcgtctcgttgccatttgtcccctcttaatgatagcaagaactaagtcatcccagttttgcacatattatacttgcgttaagttctttttccagttataagaacacaactttaatttcttatggataatttcatctgaacaacacattttagaccgaaacttcagtttccttaataatttgtacttttgattgtgggaaaatgacaacagcatacaataatagaatattatacttttctagctggggaaggctgatgacacaaaagcataggactacaaaatggcaaaaaacatgattatagtgtatacatgagtttttttgcaaagatctgaatagagaaaagcagtaaaatagtcttcacaacatatattgaaaaatgctaaaaatacaataacttgcaccattgcagctagtactatattcacattataaaaggccatttaatgtatccaagacaacattggcagacacattaaggttatgcttttgagttctattgcttttctgtacttctgttttatttgatttgaaaatatgatttgttgttgtagatctatatgccctttcaccataaagagtgtgccctttgttttatattcgtgcttctataggtaaattttaataaaaataattttaatcagcattggttgagcatagggctttttatttctttaaactggcctgtttattactcaggtttgagtagcactacactataccaagcatgaagcaaaatgtcttaacactaggggaagctgagcttggttctttgtagaaaaactctatccaggagacatggggtagattaatacagacattcacacacacctccacacatatgggaaggttgaagaatttgtaacatcatcgttttattaaaacaaaatatgtctcaccacattgttgggtacatgttactgatctggcttaataatatataggatttaacttcctgtacttgatatgcttggaggcaatattactgcagtacaagccagggcatcagtttcactatgcttttgtcagcatagaaagtagcactagaggacaaaatgaatttgaaccaatgaagctttcatacaataccctgaagggtactagtgtaagacaggggcaagaaagaaacagtgatgatgtgagatgtgacccgataactgtccttcatggatctacacaacctctggaaatgccttctgcctgcaagaagcgtcaggagccctagaacatatgctaatatatataattaaggaggccaaagacaatcataccactctattcaacgaaatttatatattcacatacatacacacatatacacgcatgccacatatacagaaatttatgcatacatgtgtattgtagtttgagtttcataataaaactcaaaagtgaagacagttcacatgcacacgaattattagacacaaaaattggaaggaggtaaaggataataaagtgttataataacaggctgaaagaactatgattctgtcttctttatcccaaaatgaacttaataaattaatataacctcaattgcaagaggaagaacacgttgaggttgcatactaaggtgtattttatatctgatggttccatagctatgaaagtcttgatgatgccaatgctaggcatccaaatttgcagaagcaaaatctctggtcagattgaaaatgtgttacagtaaggaggaggtctaatctctcatcttttttctctgcataaattttgagtgtgctaaccacacaataagtaagttgtcaataactactgttttgattgattgtattaatccaaatattgaaatgagcatgtttgctgctttactgcttccttgttaacgcctagtaaatgttaattactaagtaaagtttctgaatgaataaataatccagagataaatgttatacccacacctcaggaatgcccactggtgatctacaagagaagttggggtcaaccaaagtgtataaaggtcatacagaaaggactcaggaggtcaatgtaaaggaggcttccatcgcataaagatgaaaaatatgaggacaataaagatcataatacagaaggtggagagcctcagttacatttaaatatatttaaattcatgcattcgcagtgatgccaaaacaaacaactggatgataataaataaataaaatattcactggtggtcgggtgcggtggctcacgcctgtaatcccagcactttgggaggctgaggtgggcagatcacgaggtcaagagatcgagaccgtcctggccaacatcatggtgaaaccccgtctctactaaaaatacaaaaattagctgggcgtggtggtgcgcgtctgtagtcccagctattcgggaggatgaggcaggagaatcccttgaacctgagaggtggaggttgcaagtgagccaagatcacgctgctgcactccagcctggtgacagagcaagactccatctcaaaaaaaaaaaaaaaaaaaattcactggcaacttttggaagagactagagaagcaattcattattttgaaaattgttcttttgggggaaaaactgaagcatttactctgctttgctttgtatcaattatactatgaggcaaccaaatagaaatgcagagttctctttataagccgggctcagtgactcacacctgtaatcccagcactttggaaagcaaaggtgggtggatcacctgaggtcaggagtttgagaccagcctggccaacatggcagaatcccatctctactaaaaatacaaaaattagccgggcgtggtggcgtgcgcctgtaatcccagctactagggaggctgaggcaggagaattgcttgaacctgggaggcagaggttgcagtgagccgagattatgccactgcactccagcctgggtgacagagcaagactctgtctcaaaaacaaaaaatcaaaacaaaacaaaaagttctctttatagaactgctcctcctaacaaatgaagaagtaaaaacagtatatcattgttttgcaactcataatgaaataatcaatcaaaacaatgatcatcaatggctgccaatatcaaacgttatataccttttgttgaaagtacacaacactttctatacaatcatcttgagtaaaaaaagaacaaaatcaaactgactacaagtagctctctagacttagctgctaatttgtcagcaccacaggagctggtgaaacacattaaacaatatcatgtggatgtaatcaacaaacctagacaaaaggtcctgtttcttcaaaaatgaaaagggagagtgagaacgaggatgagggaggaggaggatgtagggtgtggaggaaacagagacaacagagagaagagaggagtcctataggataatttgggaaatataaaatgtatttgatgatattaagcaaatattttccggggctgggtgcggtggctcacgcctgtaatctcagcactttgaggggccaaggtgggcggatcatttgaggtcaggagttcaagaccagcctgaccaacatggtgaaatcccatctgtactaaaaatacaaaaaaattatccgggtgtggtggcgcatgcctgtagtagcagctactcgggaggctgaggcaggagaatcatttgaacctgggaggcggaggttgcagtgagccaagatcgtgccactgcactccagcctgggtgacagagcgagactctgtctcaaaaaaaaaaaaaaaagaagtggggtgggggggttacttgggaatacagtctgaaatgtttagagtagaagtgatatactttcggggatttgcctcaaaacagagaataggaagtgggtaggtagagaggaaaccagatggtaatgataataatggttagagctaatgagcagtgtatggtatgcattatgttacttttttattttgtatatgtttgaaattcttcataagagaaaaaataaatggtccatgtgcacctgtaacataataatgacaagatatgtcagcctaagaataaatatgtcttaagttatcccctttacctcatcttggcttcaaagtaactatatgctttaatcattatagtttgtctaggtccccagagagtgtttttagatttttatttgttagtttatgaacttcagtcaagtaatcagaaagccaatataataaaatagtctttaactttctggaaaacatgcaagcataaataaccatcatttatacttctgtagcaacagtgacattgaatcatactcaaagcaaagtatctaagattcagagtaagtaggattctcacttgtccaatgcaaagattcagctacatctggtgggtaaaggagttaaatattaacttcatcttttagtatctatttagatctaatttgtatagggggttaaggatctcctgataaaaataaaattaataacttaaaactctccataattagacaacatattagctttcatgcccatcaaatatgaggagctgcaaaaagcacagtgtcaaggggtaagtctagtgttctcacgtaaaaatcatcttgcagatacagacaggataaactaaataataatgaggcctaagatttggagtggaggaggagtcccaagtacaccttgatggctgttacctgcacttacaaccaaaacagccattttcatgtcaaatgtgtgccctgggatacaagatctatgtatacattttaaagaattattttattacaagtcactctttggggtccagcaactctactatgcctcctttataacagagaacagattaaaacactgagaatgggaagtttccccttgctgcttcatggatgtaagttgagtagctgcgacttcatgcagactgaaagaaccaagcaaagcaccaaacagtggcattgaagaggttgactgacagtggtctagggcacagtttgagctgcagcacccgtggagggaaacctctgtctagattatcattagcgtagctgatagaggtgagaaaggttctgggagaagcatccaatcacagagctaagtcaagcatcagtccaaatttcagaatgtctgagtgataaacatcctgcagggacaatgatgcaaattggagtagaaaacactgaagagtggccaaggtcttgcaaatgcacatggagatgctaacaagctagcaaaatcctggtataaagccaacactacccatgattacacaggttcataatgccacaggcagtttaggttacaataaaattcatgaattcttcagtgcttggctgggcaggatatgtactgaacaaagcactcccgtaggtactgaaaggcagtgcctattcactaactggtgatgttattcatccgtttcctgaaccaggaacataggagcccctttgtctcctctttcatccctcccagccagtccattgctcaatgtctaaaattggattccccaagatcagacttaaatgacaaatttgagtccatgtagctgattatgatggagatcacagaaagcatcaacaggaagtgagaaacaggaagatctgtgatggagatcacagaaagcatcaacaggaagtagagaagtgagatagagaagaaaggaacacacagagtacattaatgagcaagttatgactatggatgactgggacttaatgccactggagacttctagcaaatgaaatagacatgcctcatgcatcctatttgagtgtaaaaagtttagagtttttatcatccaattctcatctattattaacctgaagaatgctgcttgggtcttcaatattccagcacttctagccttccccgcagtggcaaacccatcagagaaagtcttcaggtgcacgcaattagatgatgagacaaaatgggagcgctgaaagggtacggacagcgtccactagatttaaagagtaccctacatttatcttatagtgtagactatagctgttcttgcttttttgtaccaaatgactcatctttttttccttcctttagaaacaagattgaaaatgtaatctcggttgaacaggaagcatggagatagttcaactgaattggaagttgctggttgtagaatatttctatgcattcttcaagacagtgccatgtgaagcctcttctgacctgtccagttagcttttatttctctctcttttgtgacagcactgtactttgcacatcttattgtttcattcttcacacttttcagtattatacttatctatcttccagtaaattcttcttaacagactatcattttcttgagagcaagaattgggtcttcgttcatctttgtattttaggcatggagtatagtccccaagaaccagtaagtgttcatcaaatgttcatctgttgaatgaataaatgactgtgtgcattgctgctaatgatattcttcaccattttcttcagaatctgcttatgctggtcagattaaatggctttacttgagctgtttccaactttcaaacagattttttttttttttctgacagtgatttaacaccactgaaagttttcagttaccttccagttgttttaaaacatgaaatagctatttctggtgaaaggaaataaaggagaagagatagttctcacttcaatttgagttttgagaggatcgaattgcttcagcccaaggggtcaatactgacaggtcatccctagcagctggagagtatgtcaagataatactccaaaagatatttttatccttcatttgctacaaagataaataaatgcatatatacaaagtgaacaaaagctttgaaaatagtaaaatgttaacataggatagtatagtcactgttattgaatgaatgtttgtgtccacccaaaattcatatgttgaaatcctaactcccaaagtgatagtattaggagatgggtttggggctttttgggaggtgattaggtcacgaggatggagctctcattattggaattagttgcctcgtaaaagagaacctacaggccaggcgcggtggctcacacctgtaatcccagcactttgggaggccagggtgggtggatcacgaggtcaggagttcaagaccagcctggccaaaatggtgaaaccccacctctactaaaaatacaaaaaattagccaggcgtggtggtgggtgcctataatcccagctacttgggaggctgaggcagagaattgcttgaaacccggaggcagaggttgcagtgagccaagatcgtgccactgccctccagcctgggagacagaatgagattctgtctcaaaaaaaaaaaaaaaaaaaaaaaaaaaaagaacctagaacgctccctttcccctccaccatgtgaggaatcatcaacaagatgaacgtcactgaggaagcgggctcacaagacacctaacatgctggtgacttttggactcaccagcctctagaactaggagcaacacatttctgctctttataaaccacccagaaatataatatctatatgtatatagccaccacccatatatgtacacacacacagtttatcaatttttgaagtgaaataacatataaattaacaaaaattctctcacgtgctaccacatacatagataaaatatgtatgtattttatacatacatatatgcatgtatacatacatatacataaaacatgtatgtaccacatacatagataaaatatgctaccacatacatagataaaatacttgcccagatacatagataaaaattcaagtaccatcaaagtctaccttcttcctatctataaagctataaaatgagtggtatgagactaaacagaaatgttctgtgctttttggcacaaacgcatatttgtttatttattatgtatgtatttatagtgttttcatacaaatagaacaatttgacatatatataataaactagaacacatatgcacatatgtatgtacatgtatgtatgcatacatatgcacatatatatgttctacttttgtgcaattaatactacataacgatcacatttcaacatctgtttatataaattcatctcttgtttaaaactgtagtataaagggcacaggcatggactaccaccaagctatgtccatttagattacctattttactattacctagctacaaagaaaacccatgtccatctaaacccttactcatgtgaaaacataaatgaagggcaaactccttgaagtagaattgctatgtaaatatgtaattatacttttaattttgaaagataatgccaaattaatctcaagagtctgggcttgtgttactccatagtcaatgatggcgatggtcctcaactcttgcctccaaaatgcattcattcttgaataactttgatcagatgagacacttatgatctcaatgctcattctcctactactctttggataaccttgtttgacatttttttttacagtgtgtaaagcaaagagaaactccaaactctttacaaatatgctttgctaaagaataagacctatttgatagcacaacagggtaagtatagtcaataataacttaattgtaaatttaaaaataactaaaagagtgtaattggattgcttgtaacatgaaggataaatgcttgaggggtgtatatcccattctccatgatgtgattatttcacattgcatgtctgtatcaaaacatctcatgtaccccataaatatatatatctattgtgtacccacaaaaataagatactaaaaatacaaaaattagctggacatggtggcgcacacctgtaatcctagctccccaggaggctgaggcaggagaatcgcttgaacccgggaggcggaggttgcagtgagccaagatggcgccactgcactccagcctgggtgacagagcgagactccatctcaaataatactgataatgataatgataatgataataaaaataataacgaaattcagtggattctgaataaggcacaataagaagaattttctttttctttatttagtcttaacactgaaaagtcttaatgaatgtgtatctaccatgtgaaattagacagaatttaacagtttaaaatattaatggaaatatttttcatttaatctatttgttctaaacaattgctaaaatattttggttacatctaacctcacaaaggcaaccattttctattacttttctatattcacttttttcctattatttactgggtttcttctgttattgttgttgttttttcctttttgagacagaggttcactcttgttgcccaggctggagtgcagtggcgcaatttcggctcatggcaacctctgcctcccgggttcaagtgattctcctgcctcagcctcctgagtagctgggattacagatgcctgccaccaggtcaggctaatttttgtatttttagtagagatggggtttcaccatgttggccaggctggtcttgaactcttgacttccagtcatccgcttgccttggcctcccaaagtgctgggattacaagcgtgagccaccgcactcagccagtttgttaggtttttattaggtgcaagattgtgctgtattttttaatcaataaaaacacaagcaagccacagctccaagaagtgtacaacaaatgatttgactggagaataatttttttaactaaatacttggtcacactatataagtggcatgtgaagaaaaaacagtcactttgggccgaaaatttcagggaaaaaaacccttatggagtaaaaataactttatagtttattgctgaatgatttacatttttattgatacagctaacttgtatatactcagtgttagttcttaatcatatttaatgcctgttacacatgccacattcctcatgaaactattcatgattcttctccccataccaataatttgtattattccattctcatataacatgttttcggtatgcttttaaattgacaatatattttaatttctcttataattttctatgttctatgttctatagtattaaaagattcatgacctagagacacacacatatatatatatgtgtgcacacatccatatatatttaactttatagaattcttgaatttgactgaatagaaagtggtggccaagaatattaaatctacctaaaattcacagaggtttgagattcacaaaaggtcacttgatttggcttacaggttcaggggagaaaagtaaatttcatggaagaaaatcataaatatttgcgagtagataaggtagcagatgtagacgttatctatagggaaatctgacagcaaaaggaatgagagctaggatgttacattcaggggcctgaattacagtttgctacagatacaatacatccgcacttagcaaaaattacatttataaccttggcttttaatcaaggtttaccataatgaaaagctgtgaagaacttgtatgactcgcttataatttttttggttttttttaagatagggtcttgctctgtagcccaggctggagtgcgatggtgcaatgatggctcactgcagccttgacctcccgggctcaagagatcctcctacctcagcctcccaagtagctgggaatacaggcatgcaccacgacgctctgttaatttttgtattttttttatagaggtgaggttttgccatgttaccctggcttgcctcaaactcctgagctcaagtgatctgcccaccttggcctcctaaagtgctgggattacaggcatgagccactgtgcccagcctaaaaaaattgttattgatgtcactaaaaactgctcaggaggaaaataagtaggtcttattgtgatgaaacaatattttattgaaaaaaattgatcaacattttttatttaaaaacaaaactggggctattttattcagtaatatgccagtattcacatagcaagagttttgagcataggctttggagcctgagcatctaggttcaaatcctgactttaacatttattagtgggacgatgggtaagttcattagcatctccgtactttagtttctttccatatgttaaatatggataataatggtgtctaattcataggattcttatgagaatttaatgcctgattataagtgaggttaggatggtaccttgacatagtagctgttttatcattgttctggattattatatttattatctatgcctattttatataccatacatgcctgtaaataaagtttgtctaggatgccatggaagaccagagttcaccacctttgtggagatttgataggattttcaccattagataataagagctatataatgtatgtttcctctttagtctgggctcccatgattcttggtgccaaacgttttggtttaaattcagtaactccaattgagccatatttctgtcaaattcttccaaatgtcaactatatgtggcttctagtcaatttgaccttgttttactgattctgatttagtggcaagatggtagatgaatgcaatggtttattctcgtgattttaaatttaatcatttgtaattatatacttttaagacgtaaagcttcacctgtcataaaacatgccctttatggcacaatggttttaaaatatggtcccaaaactcattggcaaatggaaaggtagggtctatgtcctttcctcttcaatctgggtgagtttgtaactacttcaacagatagaggatggcaagagtaatgttttgtgccctccatggcagggtcataaaagaccatatgactactaccttgtttgctagaacagcgtttgcttggaaccctgagttaccatagaaaatgtgtgagtatcgtaaagccaccatgctaggaagaagccaaacaacatagcaagttcacatgtaggccttcagaattccaccctccagccattgagtccaacttagctttcaagtcttgacagatgaggctatagatattgcagagcataaacagaacatccctgctgtgtcctatctgaatttattactcacagcatccacggcataataaagtaattgttttaaactgctaagtatcagggtgattttatacacagcaaaagtaagtgggataccctgccaatatgtctacatatttccaaacaactgaaaacatgcacaccccaaaatgttttcttaatgagaaaatacaactcacttttttatttctgtgccttgattaaaaaaaggcacgtccactaaaagaatgataatttttattctgattatgggataaagaaacatatggccatttgtgacatacaaaaagtctactggaagcaaaaagtgggaaaaaaaagccttacgaatacccgtaaactggtgataaatggacaaacaaaatttggtatatccatacaatgaaattttatttagcaaataaaaggaatgaaagactgatacattctacaatatgaatggaccttaaaaacattatgcaaaatgaaagattacagacactagaggccacatatagtatgattccatttatatgaaatgtccaaaataggcagatctatagagacacaacacagagtagcggttgccagaggctagagggagagaggaatggggagtgactgctaatgggcatacagtttcttttggggatgatgaaagtattctgcaactagatagtgatgatagttgcatagctctgtgaacatactgaaaaaacactgaattgtacacttctagagagtgaattttacagtatgtgaataatatcttaataaagctgctgtaacaaaatccccaggatatcccatttctaaataaacgtatttttcccttgaggtcttctgatgtttacacctctttttgttgtgctgtggctttttggaagcagatttctctgggtttgttcatttttgttttatttcagtattagaaccaaccctgcttatatatcctgtctttttttaaatttaaggcttaacaacaaacaaacagtagcaataatcccaattcccgagtgattcaacaagttttattgtgcagatggtaagaaactgtttccctcattgtttgctaccaggagaaaggctgtgaaatagttcttctgggtcaaaacatatggttcacaaaaatgacttcctttcatcttggtctcttcttgccttctgaaagaccaattcctcctaattttaagtttacttttggcaaaatggtctcatgtattaatgactttatttggttaacaaagtaacatgtttacaggcatgggagaggataaatgaagctagaaaaaggagtactgaaaatattaggttaatgtgttattgttttcaagagccatctataacatccttgaaacttacacaaccactgactaaacattttatttagaataatcaggaaccagtggaaaatctgcttatctagaccttgaagcatcattttttttttctgaaaatttcttcctgattacatccagtggcagatactgctatttgcttgtttgcttgcccaatatccaataaacccagcaaagaaatagttgtcttgatggactattaacagccaacccacagtaaaaacaaattctaaaaatttaaaaagcatagtaaccaaaaaatattcactccacattttgctttttaaactttaaaaaatgctttttttttttttttttttttttgaaaccctgaaaaagtagacagtaagccagctcctggaagaattggaaatcaactgcatgagggtctaggaagctgagaggctgaagcagtctcaggacaagtagatagggaggagtcctttttctctcaacaacaaaatcgtgattttgtttagaagtagcaaggtgtcaagcaagaacaaagagctctatttcaagcatctctggcacccagtcatggccttttggcatctgagaggacgacagctagggatttctgggatagttttgttttcctgatgtacatgctgcctcttccttcttcttgcttcctttttcatctttctgctctgaaatgtaagacttgaggctggagatgttgaaaccatcatcttgcaaccaagagttgacaagcatgagaatgatagtaaggtgtaaaagagcaagaagatcaaaggggcctgggattttcatgccatcacagggccagtttcttgctttagactccattccttcagattccatcatatgagaaagttaaaatcctctggttctagtttctgctacttcgatgcaaaaatgcaatccctggcctggcacggtggctcatgcttgtaatcctagcactttgggaggccgaggtaggtggatcatttgaggtcagaagtttgtgaccagtctggccaacatggtgaaaccccatctctactaaaaatacaaaaattagctgggtgtggtggcgcaagcctgtaatcccagctactcgggaggctgaggcaggagaatcgcttgaagctgggaggcggaggttgcagtgaattgagatcgcgcctctgcactccagctttggtaatagaacgagactcgtctcaaaaaaaaaaaaatacaaccctcacttgcagttcctctcaactgggcacaccaccataccctgggtacatttaagaaacgtgaaagcactgtgattgtccccataacggatggaaaggtgctctaaggacgccagacatccagtaacacgcaggaaagtccaggaaaatgagtaattgtttcatgtcctattcagcttttgaaaagtaggggacagcctgtttataagtatgtgaatatatagaacctagctcaattttacatataaatacaaagtctttatatgcactgcattttccaagaatgaaactatcccacaataaatcaaagggaaaatgtgcacttattttattcagaactttaccaaatgttattaatcatacagaaaaatcccattactttaaaatatgctgttcatggcattttaatcattcataccactcacctgcatacgtcagcatttcgagctgtctacttctgtggttttaggtacaggtactacatttatctagagcagtatgtacctttcttattttcatattgaataattaattattgatgataaatatatccattatttttaattcattattgtcctttgatttattttttacaaggtaattgttttagaattttatatatatatgtaagttacatttttggtaaattctctttgaggatagtaatgggagtattacaaaatatgtcttacaaaagagggtgttcagtcttacagggttaaaacctatacggtacatagaagaaaaaaagtttttaaaagaaacacggtagcctggcgtggtggctcacacctgtaatcccaacacattgggagtccaaggtggggcggatcgcttgaggtcaggagtttgagaccagcctggccaacgtggcaaaaccccatctccactgttacaataaaaatacaaaaattaaccgggcatggtggcacacccctatagtcccagctgctcaggaggttgagacaggagaatcgcttgaacccaggaggcggaggttgcattgagccgagatcatgccactgcactccagcctgagtgacagagcaagactccatctcacaaaaaagaaaaaaagaaataatgtatacatatttagaaaataagataatacacccaattgattaaattatgattttcatctgtaaatgttcctatgccttcagatgtttattttaggactgtggccgacttggttctaaagaagatggatcaccaggtcattacagggctttccttcacaattagaaactaaatataagactcaacccagagtaatttcagaaaaaaaataaaataccaatataaggtgtattgtcaaagataattgtgctcctgcagcttttctgtgtataatagactcttccttccttgtagcagcttgcctagattgtgaaaaacatggtgtttgacccttagaaaggtcaaagacttatataagatatatatgtatatatgagcatatgtatgtgtgatatatatatatatcacactgatatctatatatgtacatatatcagtgtgggaaggaaatggaggaatagaatgttaattggaacaagactagtagtagctgattagttcttcattccactaaacataacgatgggcaaatatctagctgctttaagtcttattttataaattgaatatcaaatactaaagaaaaaatacattttcacagccaggaaaaacatagaatttttttcaaatttcaaaatgccaagtaaaacttgagaggaaataccgagcaaataaggaactttgtcccaaggtatggaaacattgacaaaactattaccagttatagctgacctttactgggtaaaacctggataaacaggaaaaactttaagagaaaagtcttcttcagtgggtcaaatcccatggttttcatgaactgggcggactgctacagggcaggaagagtttactacacagagaaaagttgtgggaacacaattatctttgaagaactcttgggccagtgtaggccccgtggtgccagttccctgtgctaagaggcagccagggatatatacctcaccctttgctatatagctgccttgcttagaaacttcttctaagagaaatgccttatcttttcagatttatattaaatattttccaattctatttctgcctttatctcaggaaattccaagtgagtatgaagctcatgctccctccctaaaatagcaaaatagcaagctctttgcatggatttttaaaaatttatctttttttttgagacagggtctcactctctcacccagattggagtgcagtggtgcaatctcggctcgatgcaacctccgcctcccaggctcaagtgattcccccacctcagcctcctgagtagctgggattacaggcgtgcgccattacactgaactaatttttatatttttagtagagacgggtttcaccatgttggccaggttggtctccaactcctgacctcaaatgatccacctgtctgggcctcccaaagtgctgggattacaggcatgagacactgcgcccggccgtatgatctttttacaaggtttcaagtaacaattttatttcctttgcttcaaaatttccaactattgccattcaagtgctttccactgatagtctgcaaatacacaacccttgaagaactcattgtaactatggccaaaagagtcactgttttaaacacaatctcacataaagaagacttaaactaggtgtactagttgactccatctagaaaattatttctcctagacagaaatcttagattaggcaaatgtgactgagctaaacaaagtctttataatttacaagttcttagggatcaattcttaattttgtacaaaaccacaattaccaacatatgatctccaactctgacaatggggtcttatttttaatctccattataaattggcaacagaaatcttctcatctcatttcagtaaagttggctttgccaaaataaagaaactctctttgaacctgaatcagatgatggatgtacaagtcacttattttctgggcttagagttactctggagagtaaccaatgtttaatttatcaatgttcctagaaattaattagtttaacatgacctactgttgttaccaaagtgtttttcatactaggtaatacaaattgggcctgattatctaggcaattgtatttaattttctgttttggttcatggcaaccaaattggcacttataactttttcccttttgtccaaaattccattggaatgacggaaggtattcatgtgtttagaggaataaaattataatcaacctagaaaacaagaaagcaagcaagcaaaagaccaagatactggtgaaaatactgaaagatgtagatgggatctcactggtaaagaaaacaaagaagagtcaataaaaccacaaacaccaggagtaagaagaagcttcacacctttggttgacaaatagtgtacttcaattctgctggctgttgtaaaggagattacaggatacctggaagatatataatgggagaagtagtctcatatagaagctattgtgggtttgggtcctttagaaatttctctgaggaagaaacattaagttgtggcctaaaagatgaaaaaggaggctgatagtagtcctgtattttaaaagaaaatcagtatcaccgtaatttagggagggaggttggagagaagtggaaaatcagaaagagatagctgttaaaaggtagagccctataggttgtggcataaactttacagtaatggacagctattgaagagttataaacaacagtcaaataaatgttgtaaaaacatttattccatttgccatattgaaaatggggtacaggggccaggcgaggtggttcacgcctgtaatcccagcactttgggaggccgaggcgggcagatcacttgaggtcaggagtttgagaccagcctggccaacgtggtgaaactccgtctctactaaaaacagaaaaattaggctggtgtagtagcaggcgcctgtaatcccagctactcgggaggctgaggcgcgaggaatgcttgaacccaggaggcggaggttgcagtgaaccgagatcgcgccactgcaccactcctgcttgggcgacagagccagactctgtctcaaaaaaaaaaaaaaaaaaaaaaaaaggagtaaaatggagtacagggtattaggaagaatatataaagtacaataagatagacaaatgcaagttttatgcacaaatgaacatcgttagaactccgacacaatgtcttcttcccttcaaatgtcttcacttttccattcccactatcatccttcagcctagtctctaccaccagttttactgacgcgtcccccaaacggttccttcaccctcttctccaacctgctcccaagtatccttcatagtacaaggaaacaaattttccgaatcataatatttttcatttcatttttctgcttaaaaatttatcatgtcttcatattacttatagatggagtttgagaaaattattaaatctattccccacctaggttcgtaatcaattaagccgcacatataggagtcagacgaatagagatgaaaatatctcctttactaatgataaagctgttatcagcgaacatagcattaagtcttcttattatgtatgtttgctaataatttgcctagtgacatccattagtaagcattaaatggaagaagaagcattccctatataatttatatcatgggggcttaaccccaatttaaagagcatgaagccatacctactcaattcctcctccaaaaatcagggtagatggttcatttctgctttcttaattggagtacatggagggacagggaaaacgggcaatattattaccctagcgtagttctctccacaattggatatttgaaacaacaagcaaggagggtccaaagatttaattgcatatacattaacagtttttgtctcattttcaatattctttagagtttgcttattcaaacttcttgctaattatcatcacaagccgctatttctgtcattttccttgtgctgtccatattacttgcctcttcttttaactctagtaccaagattgactgatgataggccattcaatcttttccaaagccgaggttagcatgcttagctgaatgagttcgggcaaatttcaattttatgcggttcatagcaatagccatattaactagtatgtttatttgtctctaaataaggtttaggtattctgaaatgtctctctagcactggatttccagttaatgagcatctcactagaaatttatattgacaacaaccttattaatattaatcccctagcatttgcaagactaggacaaaatttcagatatcatttatatgatatttttgaagacattttataaatacaacaaatatgatggattatttctattactataactaaattatgttttgaaataccatactatttactaagagctataaaatgtgatagtatcctataaaattaatatctcaataactctaaaacatgtcagttgaaaatagtgcatatatattagtgtgaatgtatgtgggggtatgtcaaaagagaatctccttaatacaagcctctgctggaaataaaaaataaagaaaaaaagcagaaaatgaattatttaataatttctaagatgttctcaggtgccaacacaacaaatcctaatgaacccagggttgattaaatgcagataaagaagatatgcatttttcaaatctcatgaagagaaaaaagatttttctgtcgatcattctctaattaaagtattaacggtaagatagagactgtattccctcttactggaaagataaactgtatgtttctataatatatgtcaccctagcaacaacacacaaagcatcaactgcctttaataaaaactgattttataattaaaggagctaactgttgaaaaatagtcactttttatagacacttgaatatgaaaattggtttctcacacctcattataatactaagtgcaaattagtataagcctttgctcatccattccaagtaaagcagaagcacagacagatcaaccaacctagcactgtacatgacacgttgtaggaattcaactagttctgttaatttaaatacctgcaatagtttttattatatctgcactatggatttttaaaaaatatgtaacagcaaaaaaactaccaagaatatttataatataaacagttttttaaaaatattctttctcatgaaaaagtctatttaggaacttctggtaagggtaagataacttcgacccatttttcccttcctcttcccactaaaacagcaacaaatgctggtaataatgcaggaataaacccaagataactctgaaggtagtcagaagaagacgacggagttttggtttactgggtctggagcagaagttgagtgacttacatcttttcacttaatagaagcaagtgacccagactcaccatttcgagacccacaaccagcagtcgaaagcagcctagaaaggcttatctctccacatctaagaggattccctgagacaacatcaggttctcctgacactttctaggacaggatgggtagatgcaatccagagaattgccaacagtaaggggaaacactctctgttcctggtgggcctgcttcagctctcatccacagatacctgtgaaggagtaaaggatgttccatccccaaatatgccagattggtatgttggctattttcagttggaaactttggagaaattgtagtttcagaaagagttagctcacctgtctcttcctacatgcagcaaaccataaagattcctctgggaggggcaccctcacaggaccagagtgagaaaatagcccttattaccagagacttagaattggaggcttcaatggacctgaataaatatatttactgaagtaacccttatctttcactagttttatacccactatctatctcctagtgactcccctagagaaaatttactgtccctagccagattctctttatcctgtcattgctttccaaattcatcaaattcatcattcatcattaaaagcatcttgctttgactacttcttcaggcttcactttcttgtgatgatctccacgtacatgtataagtaatacaatttgtattcttttcttttgttttctgcctgatgtcgatttggtttctagatccaactgaagagcctactaagaactaaaagggggattggaggtgatatccaattcccctacacctgcacatgtgatgaaactgtacagaactaaatacacacacacacacacacacacacacacacacacacacacacacacatataggaacaccgagagaaactgaataaaattgctgaattgtagtaatgtcaatattctggctgtgatattatattatagttttgcaaaatattaactttagggaaaaaatggtaaagtgtacataggatatccgtattatttcttattaactgtatatgtatctacaattatctccataaaatgtcaatttttttaaaagtcaattttgatttttttattttctgtttggatttcactagatgttcttattgattttattcactatataattgagaatcatcttgctctgtgtttactcagagcaagctgaactttcagcaatcttatttttaaaaaatgctacatgatatgaccttatcagcaatttactaagttatttgaatggactttatggacatgaacttatcttcaaagcgtcttttctgtttaaagctatgtcctttaccgttttttttaaactggaagcattccttccctgccagctaaagaaaattccatgttattaaaaatggtggttctcagccataattaatacacatagttcataacacccatttaaaattggtaatgtgtttataagagaggtgagacatgcaagaaaagaagtggtaccaagtgatcaccagagacacatggagtgtgtgagtgtaggagagttatttaacctctgtgctatttatttatttacttatttgagatggagtttccttcctgttccccaggctggagcgcaatggcgccatctcggctcactgcaacttccgcctcccaggttcaagcgattctcctgcctcagcctcccaagtagctgggattacaggcacccaccaccacacccggctaatttttgtatttttagtagagacagggttttgtcatgttggccaggctggtctcaaactcttgacctcaggtgatccacccgctttggccgcccaaagtgctgggattgtaggagtgagccaccgtgcccggcccacctctgtgttttactttccctatctataaaaagggaagtaaaaatagtatcttctacttaggatagttatgtgctataatatgtgaagcccttatttcagagccaagcatatagtaagcacttccataaatattaattattattattactcatggaacataattgattcccattagaatttgtaggagtaaggaggtaacactttaaatctactttgttcagagctgcttctcgctggaaaccttttaagtagtgtttgtatcaccttttctcctagcacttacatagtgtactgcttgtgtaattaactccatggataaagaaatatccttccccttccatttactagctttttaatagtgcagcttcaggtcttccactagaaatattagaattgtcacttaattttcaacctcccgatatttaattgaaagatgtacaatataatttaaaaggtacctacccatagggcaactaattctgaaaacgggtgataagtgaataaaggaagtatgcttaatttcattttcatgctttcgcagtttctatcttatattgataaagaaatcctaagctctacatctgtataagaatgtatcatcctttcaatatacttgtatctatataaaatgcagatgtgtatattcttgtgtgtgcatacacacatgcacagctatagaatatagatattttaatttagataattttaggactttacataaaatgaatcacatatgcactattatgatgttttccccaatgcaagataatattttctaagattttagacataagatgtattttatcatgtacaatgcactctaaaacttaccaagtttccatttacaagggaaaacgattaaaaccacaaattgctatagttaagagtttgggattattttattttattttacaaatgagagcattcatttctgaatacctaccataacacatgcatacatctgtcagaaaaaaaaaatcatatttagaatccaagtttactcccggagaaccttaacctatttcaaaaacatctttgggaagatgtcaggaattttcacaatttctattacactcttctgatttgagtcaaagaaaataattttcaacataataggacagcccagggaggcgagtttcagccagttgctgtggaaaaaccagaggcagtcgctgtcatgcagctgccaacaccacagttgggggccttgccaagtagacagatgccaaaacagaaaaaatagcttattccaattaattgttgaaacctataaaggtaaaacacttcatgtgtgggcctgactacagaactgctttgtcccccaaaggcatcgtgtatttgcttttcattgtgggggttgctagaaacatagaaataatattattaaagtatagaagatgtccaaggaacatgcatctttcctctagcaaagaataatttaaaattaaaataagtattatacttattacttttctaaattgcgacttctctccatgcctcactttccctctctgtaaaatggagataatagcatcacactgctattttaatgagaaaagtgaaataatacatgtgatgtacttaatggtgccaagtagttagcatacatcaaacatgagcaattatattattcctattattataccaagttagttaaacttgtattattttactactaatatttgtattactgcactaagttagataaatcaaaaccattgttaaagctgatctagaagtaagttattagacatttctgtttaggagatatcagttacttagaaatttagttactataaataagtcttacatatagaaaattacctttttttggtgactttagaaatttagggcgtaagaaataacttttcaaagaaaaaaattatgtcatcattttaaagagctctctcagtgagtattaattgtgttcatagctagataaatgtgtgcacacacaacacattacggccaattcaaattttaaaacaatgccattatagtggaatttcatcctattctgtatgggatcaaagcatccagaggtctaaaaaacattaaaataaccaatcctctaggtgctttttaagttttcagttaatttgtcttatctacattgaagcaaacaatctaaaacttgcaatggatatctgtgaagcatacatcaaaagaaaagtatagtagctgttagttcaaggaactgaatgatagagcttccaattaaaaatacacacatgtgttgtttatcttatttcagtgaactaaaaggttatttgcatttcttgtaaagtgtgctcatccctttaagtttcagtgaactgtttgagaagacatagggaatgggaatgcattttattacaacctttccctttatttggaaagattattcggtagctgtttctgaaatgtctagtactactgtgaaaaactagtacccacaatatagttctagaaacagaatagacaaagttgcttctgatatctttctgtctactagtcaggaatgcaagacaatttcagatcaatgatccttctactatcaaaagtcatgggacctaaggatcaagatcacttttatttttgctccatttgaattatccaggcaaaaccaatgacataaatgaggccttacgtgacctgacatccctatgcctgatctagcaggactgtgacatcaacagtaaagctagacggatcaaaaggtgcctccaatgcccgtgtcagcgtcagcttcagcagaagctccccacttggcattcctgcttgagtgctttgcagtcctggcatgtcacctaactggctggtgcttcctaataggccctacaccacttctgattgatgtgtgaatatgcaaaccttactggaatccaggagccagatggcccacataccaagtatagcagccagacaaaacagaggcagattcagcaaactgttggagagttacatttttggtgattcctacagacacctaagtatacatagtcctatttaattgatttcattccatgttaacccacaacaatagtgcctctgtcattaaactgccacattctaattaaaggagaaaattctttcttttctcctttccatttagcatgaaatgaaggcttttataatcaacctgattctaccctgctacttgtagaggctgtcatgtagtctctaaaggcacaggtgaacaaaatctctttgctgcttctctaggataaagcagtcacttatttctttcattaaacttagatgaattatttaaaacaaaagccataacttgtataaaagagtgcccagatgagggtgtatcctccctgagtgagtaatatctagtatatatcagccacacaataaaaaatgatgaaaatggtaaaaattataaaatgataaaaaatgattaacaaaacacaggaaaatcatatatacatatatatgtgtatatatatatataaaatcacacacagcatgtctcataatgaaaagtagaagttacttaatatcggttttctttttttacatatgtaaaatatcattcatgggtgtacttgtgtgtgtgcacaaccacattgaatggagacatttcaattagaacttctccgatagaagaaatttaatccacaaataggaaaagcagtatatctcagcgttaatcacttatgccttaaaaataatcatgatagcaaccaaaattctttctggaatctgaatcagccacacacatgtgtttctgactttattcattaagattagcagccttccagaaatcactaaaatggaatcttcaaaagctccagttcaagatctggagataaaatgaaagtctggtgatcctttccatagactctgaggactttctttaccgtcttaatgtcttcaatggaaaaacgaccgtgtatgacaaaataataagtttgcttcctgagcttgaaatgaatggctgcctatcagatccactctgagcatatcacttcaggctgtcaggccagccacattgctcacaatttccctttgggataagctaatcctaaaatcattttatagtttggatagtttcagcatgagatattgatgtctttgtagaagttctattgcataacatatacatggaagactcaagttatacggatatgtatgtactacactaattgtgtagtgtgactatgtatgcattaagaattttaatcaattgtgtaaagggaagcaaatgttcatctttcatatctcaaccaatagttttggttctcatggaaatcaaacattacctttttgtaataaaatcagtgtttcaacagaaatatatttcacaatgaaccttgtttataatgaccatctaaaatttctttaagagatgggcattacaggtcaaagataatctgtatgaaaaaaatacataagatattataaaatgtagcttaaactgttgtgtattaggaaaaatttaatacaaattctgctataattcaaaaagaaaataatgaagggaaataaaagaaaagaataaagtggaacaaaatgtgtcacataaaacaacatataccagggtagggtactataaagttttatttctacagctttgaaagaagctaaaaactcacttgtgactctgtagctcatgagtaatgtggtcatttcaaacttatggtgataaaactttatggcactctagttcagaacatatgtcaaacagagaaaaaagtaaaaatcaaaatgaaatgtgacaaaacactgcaaaacccttctcatctgacaccactattctggttttgtctgggaatcggtggtcaatttcattttgaaatttctgtctcagagtcatgtagcaacttaaatgactgctctgattagcatcaaagtaagtgtagaaaaatgatttgctttcatcatgatggtgttaacaatatgtacttcagaaaatgtcatcgttagtgttgctaaagtaagaacagaagcataattcctgcagttaaattccaatctaagatatttgaccttcacacgaaaagaatgaagacaaagcctttctcttttaaaaactatttttatggaatatattaattttagagaaaatgtcatgtctttacaatgagagctcaatattttcaaatgatgtggttatatattaaatgaatacgttcattttcttaccattaaatttttggtattagttctgggaggccataatttttctacttaaatttttgcctgtatataaaaagtactttgtgtaaatagagtccaatttgactttagtttattagtattaattagttgtattttgtcacttggacaacttgcaaaactttggtgttattctgattgtcactccattttcttagctgtagggccagaatctaattaatcctattattaatagttgtctaatttctcactattctgttccttagcctaaaggtttcataactctgtatgaaaatgagaaaacctgtcattgattaatatatgtttgtttttgtattaattgtgcaactgcaatgttactgcacatagaaatgtaactccttgattgaggagcacattgccacacatggaatctccaaaatgccaagtgaaaatcaccactcttaagagtttatttcagagtgttgactaaattgtttggggacttctttgcctataacataaacttaagagtttttgaggtacttgttttccttttaatcaaatacttagggaattataagtgtcttcttagagaccatgctttcatgcctagctacagttgaccaactcttttaaaaagctttgtctcctgaaataataataggaacaaactcaacatttctaagagaagaagacaccgttatcaactgagtgcagtgtaattcatcagtcattgataaaatcatattctagattaatccaggattcattcaattatttctaccaaatctctttcccttcaagagagggagtggagttagttgtcatccaaaatgctaatccaaaataataagggccatttaagagaagttattgagttgctttagaacttgtagattctatgctatgctgtcactgtaagtagcattattttagaaaataaacccctaaaccttaatttaacatgaaatggttcataactacaaccacctgaactgtgatcaaatcatgtcacttagatccatgtaaagcagtacttactacacccctctcacctggagagtttactgaaaggcatacctagggaaaaggcattcatctagtgctgccccagtttgaaagcgtaccaaaaagtattcacacaaggtttgtgtcacacaaggagaaactgtatgtgcctgttcttgaaacccacagcagtaatggtaacagaagaataacaagaatacatatcttgattccatataccaagctttatcctagaaaaggttgggattactggacttaaaagaacatggtattccgtaatcagacaaccttaatttgggaccattctggagactgcttaccacagtgataattatacctaatttgttaaaattcattttttccaattataataataattagaaaactataaaagtatacaaatgcagtacgttttatcttagttttcttctacttcaaaattatatatattatctaaaatttgtttttcttttcaggttatttctaaggtactttgatttttgttaaataattcagtttaaattccacgtttttatgtagaaaaaaatcaaggatttgatttctcttatattcaaaagtgcaatcgttttctttctacattgagatgaaagtattttggagcataaacaatacacgctaaataattgcaaatagcttttaaaggctaaagtttgcaatactgaagagctaaaccagcattgtccattagaatttttggtggtgataaaaaacaaaaaatgttctatacatgcactacataacacgatggccactaaaaccatgtgactactgagcacttcaaatgtagctagcaaaatggaggaacaacatagtttcttttactttcactaatttaaattcaaaataattttttgccattgtctaatggctaccaaattggacagcacaagtctagaatttaattactaatacatgtatactttttttattggtacatatgtcatataaggttgtatgcgcagaagcatacagataaatggatgccatcttgttactatctaaaagccaacatacaaatgttttatgacttaaaaaaatgccacagattcttgcttcactttaatgtgaggaactcagatatttattaacataattttgaccaaaagtagcctccataccaaatgcaattatttagccatttctgcaagactggagattttttccccaaaaactaactagaaaaataacttaatcctctgttttaatatgccatttcacagcttgcaattgcttattgtgaatgctcctatttcttttcttgaaactttggcaaaactattatgccagaacatgatttacattttgtcattcatttaaaattcagaatggctttttatgccattaagtctatttatttacattaaagacaaatgcatacttaacaatttggagaaaacaatcaaaagcttttgaatcattctaattggtgagggcttattctttaaaaagtaacatctatttgatgtagatctgtgatctgacagaaaactaattgttttaagtatttgtaatccaagcagcagtgatgcaaatgaatttaattatcagtttaaaaatccaaacaatgggaagtaagacaacacgctgccttcaaagctatagtaataaaagaagtgctagtacatttcctcatgtacctggaaatgagtggcccagatttgcttgcactaaagtctacatgcctaattttaatcattttgattgtataatcaacttcccccagtcatttctaaagataaattaagatgcatgctttcattaagaataaaacaccctgatttcttcatatttctaaataacttgccttttccaggttttctgaggtaagaattcctgaatgatactcacaaaagtaaaatgtacactgaatctagtaattatatttattttaattttctttctttaagaacagactgttggccaggtggggtaatctcagtattttgggaggccgatgggggcggatcacctgaggtcatgagttcaagaccagcctggtcaacatggtgaaaccccgtctctactaaaatacaaaaattagctgggcatggtggcaggtgcctgtaatcccaactacttgggaggctgaggaaggacaatcgcttgaacccaggaggcagaggttgcagtgagccaagaccacgccattgcactccagcctgggcaacaaaagccaagctctgtctcaaaaaaaaaaaaaaaaaaaaactgtctattttatattgaatttgagtaaaatgcaaaatatgcagtgaattttactaaaatcaatgtattttactgaatattagaccaacgcattgtagttggggattgcccctttggcaaagctcccatttagttcccaactattctgatttatagctaatatggagaaaagttaggaaatgaagaatttttggactgacacaattataaaaccaagaggaaaaagcctacagtttttaaaccaaaaaacctaactttagaacccggatttgtgagtaagtagtttgagcaagtcatttagacaaatgctcttcaagctataggtcaagacatttgtgagctgtacaacccgtttatgtgtcataactgccattaatgtaaaaaatcaaatagaaggctggtgcggtcgctcatgcctgtaatcctagcactttgggaggctgaggcgggcggactgcctgacctcaggagttcaagaccagcctgggcaacacggtgaaaccccgtctctactaaaatacaataattagccaggcatggtggtgtgtgcctgtagtcccagctacttgggaggctgtggcaggagaattgcttgaacccaggaggcagaggttgcagtgagctgatatcatgccactgcactccagcctgagcaacagagactccatctcaaaaaaaggaaaaaaaaaaacaaatagaaaagaatgaaataaaattattaaagtgtggctacatatactaaaaatgccaccttttataaaacttttgttttatttctgcatgtgtctgtgtgttttggggggtactggatcatcaagagtgctcactttttctcttaaattggattgtgaacaatgtaggggagaaaaaattgatttcctcgcctatcacaaggttcatagctgagacccctatagcaaaagaaaggttaacaagagaaaagcatacaaatgtatttaatataaattttacaaatgataccaggacacaggagcattcagaaatgaatacctaaagaaaaaggggagacctgtgtatttttatgctaaatttgatgaagagtggacaacctggcagaagtatgattggagaacaaaagggtgtaatctaatggtaataaagttggggtgggggggaatgtagcaaagcctgtttgttcagtcttctctgtgtcccagtgtgacattcctttcctttaggtatgggacacatgaggggtcttatggcctacttcagagcaaggccagataattcttttctgatctgcttcagaggaaaatggtggcagaaggtcagagactttctcacttccgctgtttcccgaaatgccaaggtgccatatttggggatgatatgtcctaaatcccactaacaacaaatataaaaaaggtggaagcccccaatttaaaaaaaaaaaaaaaatagattgtttaatcatttgaacttgggaatcttgaaaatattaaaaagaatcctgattctttctccgtttagccttgaacaagttatttaactattctctgctttggttctgtcatatgtaaaatgaggatactaataatgtctatctcagtacgttgctttaagaattaactgagagtgcacatatatctttgacaaatcaattaaaatacctttggatatatatccagaagtaggaaagttggatcatatggtaattccatttttaggtttttgaggaatctccatattattttccaaaatgaccatactaatttacattcccaccaagagtagacaacattctgaccacaaaacataagttagtgaggtgatagatatgttaattagcttgattgaatgtttctgtaatatattcatagattaaaatatcacattgtacaccataaattactcaactgttacttgttcattaaaaataaataaataaggtcagtcaccgtggctcacgccagcactttgagaggctaaagcaggtagatcacctgagctatggagtctgagaccagcctgggcaacataggggacccccatctctacaaaaaataggaacattagctgagcatggtgggggacacctgtagtcccagctacttgggggttcaggtaggaggatggcttggaggtcaaggctgcaatgagccgcaatgactccactgcactccaacctgagtgacgaagtgagatcttgtctcaaaaaccaaaccaaaacaagataaataaatgcaattaaagaactcatgcaaatccattataacaatgcttgacacttaataaaggctagccatctgtatgacatctctgttctatgactttttagttacttttaggtttaatgtgaatgttttttctttctttttaacttaaatgccgtataaagcactcttttaaataatgtacatagaaactttatctaaaattcctagttatgtgattttgctaacaggcatatttttcatggaacaaaaagtcacggacaacaagccctcattgtccatttttctcatatgaatttctctgtacttgaaatgttactgtcaggacttggctctgccctgcttctatcatgcctgtcaccttattcaatagaaacaagatgagtgttcttggcattgggaagcaagaagttagtattgtaagtatgattatttcacacaatactagaaatcgttgctgaggaacagcctgcatattgccacggaagaaggctgggatcctgtaccctgagataggccaagtgaaataaggtctattcatagacttgtatggtagttacaacattggttgttttagataataatgtagacttcataaatcatctaacacttggaaaatattacgtaccatatagtaaactcttgaaagagcattttagtacccccagaacaatgcttgaaaatttaaggcaaattacttccaaatcaacacaattttgagtgtaacttaactctggcctttgatatggtaaactgccaattatagctatctagctcggatttaaattgaattagattaaactgtgacccagtgatttttctggtttcttatgtggtcagtgcaaacagttatatttaatggtggtaaagctgagataaaaacgttaaatgtaagagtcaattgcaaggtcattttctttccaagtaatgaaaacgtagtacttgatccgctgtaaaattacaggctaatgactcagtcctacagagtagctctcaaaccttgttcgatgtacccacactgatttaagcaaagacaaagtatcattttgacgattaaataatgacaaggagcataaatcacgtcttagatggtgccacaaaatacaaattttaaaggtctcaatagacatttttggataaaataatgagaaaaaaatgttcaatcaaaggtggatggtaaatatttacaaattttaaaaataaatatttataagtcctattacttaaaaaagtaatatagtacacattgtaatattttaagaaagttttagtattgttttctgaggcatcaaattccattttttgaaagtatcatgaagaaggatattaaagtactttagattgccctgccaactgtaggagaccgaaatatgccatcccaaaatatgtcacaaaatatgtcaagaaagcaggcttgatggccgcggtggctcatgcctgtaatcccagcactttgggaggcagaggcgggcgggtcacctgaggtcaggagttcgagaccagccgggccaacatggcaaaacctctaccaaaaataaaaaattagccaggcatggtggcacacacctgtagtcccagctacctgggaggccgaggcaggagaatcgcttgaaccctggaggtgaaggttgcagtgagccgagatagtgccattgcactccaccttgggcgacagagcaagactgtttcaaaaaaaaaaaaaaactagcttgcattttattgctggatttctcaagttgtgctcatagggcacaatggagaaagaaaaacatgttctaataacatattttcaaggttagccattgtcaaaagttttcattcactgaaataaaacagattaatgaatctataagaaagcatatgtatatttgcctttttctgttgttatttttatagatttaggaggtacagtgtagttttgttacatgcatatgttggatagtagtgatgtctggtcttctagtgaaaccatcactccaatagtgtacattgtacctaataggtaatttctcactcctcactcccctgccacaatctcaccttttaaaaaattttgtatttttaatttttgtgggtacactgtaggtgtataaatttctggggtacatgagagcctcccgccattttttttttttttgagatggagtctcgccctgtgcacccaggctggagtgcagtggcgcgatctcggctcactgcaacctccgcctcctgggttcaatcaattctcctgcctcggtctcctgaatagctgggattacaggcacgcgccaccatgcccgactgatttttgtatttttagtagagacagggtttaaccatgttggtcaggctggtctcgaactcctgacctcgtgatctgcctgcctcagcctcccaaagttctggggttataggcgtgagccaccgcacccggcccctctcaccttttgaagtctccaatgtctattattccattctctatgttcatgaaaatatgccactttgacacaggactattttgagctaaaggcaattcagaagaagcagatataagttctctgccctcccactatttgcctgaaaacagtacatacatttgcaaaggtgtccatcctctcctctctatcagaaaggacaaagtttgatcaccaatgacaactttagatctttatcagcccggagactgcatcagaggaatctacataataaattttcttaactagcctttatctaccatcagtttcccatatatttgccttcctgaaattggccactcatagagactcagggtccttttcccttgtcttgttacttctcaaaaaacgtattgttctttgtcagagaaatttattcatttttccttatatatctttcatgtatacatgaggtgtgtatgttagtaaactttattgtttttttcttgttgatatctcttttgttataggagtcccagttaagaaataaaggtagaggctagatgcggtggctcacacctgtaatcccagctctttgggaggctgagactgaaggatcacttgagctcaagcattcaagaccagccttggcaacatagcaagaccctcatttctccaaaaagtaaaaaaaataataaattagcccggcatggtggtgcatgcctgtagctaagctaccggggaggctgaggtggaaggatggctcaaacccgggaggttgaagctatagtgagacaagattgcattaccacactccagcctgggccacaaagtgagacccagtgtcaaaaaaaaaaaaaaaaaaaaaaaaaatcaaggtagaggtaaaattatgttttcttcccctatgcaatgtgtttcttttatttaaatgtttatttagcaaattgtttacctgatgaacaactaatctgagagtgagtagtatgagcaaatggcttttgtaaagattttctcaaatttacctgacttgagctaaccacattcagattttaattactttaaagttctctacctatttatatatatatatacacacacacacacatttgcatatatatgtttatatacacacacacacacaaatgctacatatatattctaattgttttattcattttctgtgtattttaactaacttattgagatgcttgaacaaattgaaatgctttttataatgcttttaaaaataatcactacatataacatattctccagtagttgaacaatgtaaagaatttcttatatgtatgactttattctaacattcatatttcttgggtacttactaaatgttaggcactcacagctagtaatgtaaaatggtgggcaaagtctcttccaaaactatagtttataggctaataatggaagctttaggacacttttccaataattacacaacatgttatagtttgaagtgtgaaccttcgaaacagaagttgctggaaattcagtgtccttacactattcgaaggatttatacatgcagaaccagaaaacaaacaaacaaaaatatctcagttaaaatcagtcacttcagaggaaacaaattgatcgcgatagcagtagggaaaattttggagaaaaaatgttagctttgaagcaagcttgtccaacccgcagcctacaggctgcatgaggcccaggacagctttgaatgcagcccaacacaaatttgtaaactttcttgaaacatcatgagatattttttagatttattttttttagctcatcatctatcattagtgttactgtatttaatgtgtggcccaagacaattctcccagtgtggcccagggaagctaaaagttctgacaattctgctttgaagactcccttttaagttggcaatgaatgtacttacatgattatgtaggtattgttacttaaatgtaacatgttacgtttaacatgtttaaacattgatgaccaacgcagaatctcagcactttgggaggctgaggcgggcagatcacgaggtcaggagattgagccatcctggctaacatggtgaaaccccgcctctactaaaaatacaaaaattagccgggtgtggtggcacgtgcctgtagtcccagctactcaggaggctgaggcaggagaatcgcttgaactagggagtcggaggttgcagtgagccaagagtgtgccactgcactccagcctgggtgacagagcgagactccatctcaaaaacaaaaacaaaaacaaaaacaaaaaacaaaaaaaaaaccgaaaaaacaagaaatgtcttctgaccaatttctgtttctggtctgtgcatttgacttgagcacagatccattgttgcatacttgaagcgtcacgtacacgtgttgagttaaggaaaaaaagtcacattttcttttgatcactctcccatgtaacttcgttgaaagttacctttcattcctttttccatatcatttcctgggctagtcttacataatgttcaaacagggatcatgtaacgaattccatatcagtttataagctagactattaagattggtaaatgtatattttgtgttttttttcttactgctttggagtattgaaaggagttttagtataggggtgtttttatactaaacatactttagtttacataatagagtgtacatttactatacatattttattcaattcacaattttttttaaatcttgctttgttcaatagtgttcattatatacactttgaacctggcttcaaaaatagtacatccttctctattttatgcattttatatcaactatatgtaattgtttcaaattaagattttagataatatcctgtcacattacacttaggttgtctgaccaatagtttcttaaagattcctctatagttacattttctagtttcctttgcaattaagtttagccatataactgggttctgacccatgggatgttggtggaggtgacaaaagtcccttcctgacttagtcagaatattctaagacccctctatagctatgctgtgtaatgtggtagccactagccacatgtggctttggagcacctgaatagtggctatcccgtgttgctgagatttgctggaagtgtaaaattcacaacggaatttagagaggtggtacaataaataatgcaataaataatactaattgatatagtgattacctgttgaagaaataatatttttgttttacatatagttaaataaatattattaaaattacttcacctgtttcttctcagtttttaaatgaggctataagaaatgtaaatactatataaactttttgcaatacatttctattggatgtgctgccaaacttctcaggattcctatatatctttctattctactacatctaccattcatttcttcatcattaattattctatattttttattataaatttactgtgcgctaggcactctaattattccattgtttattataaatctactgtgtgccagctactcttctaataatcacctactgttaagacacaggatgggacatgtgacttcatgataaaaagggggaaacaccctgatataggaactgaattttacaagattttttgtgctccaacttcagtccctgccagaacaagcaaaaggagtgactacaatgtgactttctaaatggttgtattgaggaccacagatgctgggtcctgcctattaggaagaatgggcacactgagttatgaaatgataaaagactcctgtgtctcattctttggccttcagggactgtggtgattttgcaatgtctgtgaattgcccagggcttcagtgactgtggtgatagttctaaaacagggacacacagctttaggaacagtttcagtctataagtctgactatatgtacttcctgttgataaactcatgcttttgtcagtcttttgctaatactgaaaaacactcatgaaccatcctccatttcccattattattcaaggactttagacattcagagttctcagacaattttttcttttgaagagaaaatgtgggtggtttctttacaacttttttgttttgtgtattattattagacactgtctaatgttacatagaaaagaattggttgaagacaagaaagacagcgtctaacagaatataaaataaagaaaaacaaaaccaaagcattcaaataattaatatgaatgagaaaggtatcatttggtttcgtttctactttggctagacagtttcagtacttctgacttttctcataagtctttttttctaatattttaagcattgtttctcttcattatcttacttaatctaaaacagttccctcaaaacctttttaattctcttttaaaatctctacttttatatcttttaaaaatataggcatcaacattatactttaatactaacaaattttactatagaaaattgtgaaagaaccaaaacaacagtcctcttgttgtaaccacaagagcttactaattcatttttaaaagaaattatattgcctattcattccccttttggttaccttcttgctcaagaagtaaggtactttgcaaatggcatagttgatcccagcacctagatatatacatctctaatcaagtgccttttctattcagaaggtaaaagtgtaggtgaattatcagcccaatataataagatcttatcagtgtgtcactagtggagggtgcccaggttcttggtgtcttgatcaaagaattggacaaaatgcacaaacaaagcaaggaaggaatgaagggatttatttaaaatgaaaagtacatgccatagtgtgagagcgggctgagcagcggctcaagtgcccagataaagaaaatcttctggggtccaaataccctctacaggtttcccattggccacttcatgctcaccccacgtaaatgaagtggtggcctgcaattggtctgattggttgtggaaagcaaccaatcagaggctgaagtagagttacataggacactctcctgtgcaaacatctgattggttgcaaaaagcaaccaatcagaggctaaggtgaagttacaaagttgcacttctgtgcaaagactgggcccgcaatcagtctgattggttgggaacagccaatttcccatctgctacacagaaaaggtgggaggtttgcaaagggagtagcctctggtccttatgttacttaggggtggaaagttagggttttgccttcagtttagtcctagggaagtcagcgtgaaatggccttaggttcccttcctccagaccctattctcctgcctcaaatgtgtgatatttttttctcgaaaaaaaaaaaaaaaaaaaaaaaaagaagaagaaaaaagaaaaaagaaaaagaaaaaattcctcagggacctctgcaccaggtgtgctaaaacagagcaacacatgaaaatgtacttccttttcctaatttttcaaaattttaaatttttttattttaatacttttgggggaacaggtggtttttggttacctgggtaagttctttagtggtgatttccgagattttggtgcacccatcacctgagaagtatacaccgtacccaatatgtaggcttttatctctcacccatctcctacccttccccctgctctgagtccctagagtccattatatcattcttatgcctttgcatcctcatagttgagctcccacttatgagtgagaacatacggtgtttggttttccattcctgaattactttacttagaataatggcctccagttctatccaagttgttgcaaaatacattatttcattcctgtacttccctttcaaccacagaaaacaaacaacaaatgttatcatttatgaagaataaaatcttgtgtattttggggagtggaagaaaggtagcacttcttttataagttagtgctattattttataacttgagacatctgattagcttacctataacaaagtggaaatagaaaatatataatatacagtaaactattcatataatgtaactgtttagaatcttaactatcaggcagtgtatttaatgatctttcaagttgcttcgtattttctttttgtccgtttttttaattcaaattattggtttactgacttagatgataggtttgttctttagcagatatgctgaaatgtcttatataaatagtctctgaataaaatcacaatatcagctatcataaaactctacttacatagctcgtttaatatattattagaaacagtcttcattttaaatgcttcttccagaatgtatgcacatattatatagtgaggcatacttaaatattaacaggacattgctgaccttccaaaattgtattcgatgtttcagaagtaagttatgatactacaatcagtaatataaagcattctgctatgactttattcttaaaagagagaaactaaatcacatttacttgaaaactggcatattgaaatgaaacatttccatcctttgtggagatagagaacgctccagattcttgaagagaccatcagagaaaatctaggccaacatttattgttactaaatgcataaatttctctttcagtatcaggaaaatatatgagtatgaacatctataaatatgttttaaaaattatttgaagcctttccaataaaatgacaggaagaaaaccttttaaaaaggtgtaactctacaagcataaagaaaacaggagaagaaaaatgaacaactcaagatgttagcaaattttgggaagtacttccttgccttatggctctaacaaaggctgcaggctcacccactatgttccttggccaggatgaagtatcatatattcttctaatgagctgtgacttctttcagtgtggaatgagacttaccaatgaatatctgcatgctaggtatactcattactaccagaccttcccagctgatagaaatatatttttacaaaacacattttaacaaattgttagtttttattgaaaatttatatttaatatgatagttttccctaagttttaatttataattttatgtttccctatcccttcatcgatatttatttttagtgtttttctggttatttttacttgtgtatttttttataaaaagtttataatcaatttatccaactccagaaaaaaatactacttattatattggaatgcctttaatttacacattaacttaaaaacaatagtttactttataatgttaagccatgcttttcaggaacaaggagcatctttctccttgatttccttttgggttgttcaggagagttttaaacataggtactgaaatttcttgttaaatgtgtttcttgtttttgctgttgttgctattgttgcaaatgggtgtgcaccatccataaaaacttctagctcattacctataaaatgaattttactgattttgcctgtaaattttatagtctgctaacttactaaattattttattggtatttgtttgtgttcatatttgtgtttgttaatattattgttttgtgtgatctcttgaggtaaacaattctatctgtaaattgggatcccattaccactgcttgcaattgttttgcctcgaattggtttatcttgtctggttgcaatggctaatattttcaacacaatgttaagtattaatggaggtagctgtagtactcatatggttttcctgtctttatccagaatgcatcagatgtttcttctttaagtaatgtacaaacttttggactttacacacacacaaacacacacacacacacacacgcatatatatatataatatgtcaacaaaattattcaattctgttttatattaaatgtactttaatcatgaaatagattttaattttatcaaatgttagtatctcacacttaaatataaaccaaaagctaagatcacttgtaatttgaggaatgacttcaataatgagaaacagttcctcaaaataaagcaaataagaacaaatgggaagaagacagaaaacatgagcaatgcaagcagaagagaattatgggaaaattataattgaggtccacagaaagttaggagagaaataattgtattttataaaacaaggtcatgacaatataaaaaaatgaacaaaaacacctataattgacatcctatttagtggtgagaaaatgaaaactttctcaggaagatcaggaacaagacaaaaatgtctctcttaccactctttttcaacatcatattggaagtcctagctaatgcaataagacaaagaaaatagacatatctattggaatgtagaaatgaagctgtatttcttcatagatgacatgaccatctatgtagaaaatctgaaagaatcgaaaaataaccctggaaataataagcaattgtagcaaagttgcaggacacaagattaatatataaaattcaattgtttcttacacaccagcagtgaacaagtggaatttgaaatgtaaaacacaaagccatttccactaacattttcaaaaataaaatactgaggaataaatctaaaaaatatacaagatctttacaagaaaactacaaaactctgatgaaagttatcagaggaactaaatgaatggtgaaatattcagtgttcatggatagaaagactcaatattgtaaagaagtcagttctcctcaagttgatctacagatttaacgcaatcccaatcaaaatcacagcaagttaccttgccttatatagacaaaccgtttctaaagtttatatgaaaggcaaaagacccagaataacccacacaatattgaaggagaagaacaaagttggaaaactgacactatctgactacaagacttactatgaaatgacagtaatcaagacagtgtattggcaaaataatagacaaatacatcaatagaacagaatagtgtggaaatagacccacatgaatacagtttactgatctttgacaaacgagcaatggcaatagaatggagcaaagatagccttttcaacaaataatgctgaaacaactggacatctacatgcaaaaaaatgaatgtagacatagaccttgcactctatcagatcagaagagagacaaagatcaagttactgctactggatttacaagttaacgttcactggttgtacacactcatacaatgctagaggcacttgtatcatctctcattgttccttattttttaatagagataaatgtatttattcttgttcttgaggataaattttaggagttgaaaataaatactccttccataaaaacatactaaaactaaaattattttcaatgattttccatgggaaatttacctatactttgccaccaaactctctcttgcaatagtctttcttatcccagtaaataaccatcccatccttccttttgctcaagctaaaactgtttttctccactctctcaatctccatttttagtccaccagcaaatcctgttacatctactttcaaaatgtatccaaaattcgatcatttctccccagatccatggacatcaacctaatcctagccacacgcacacacccagccttcattactacattatcctctaactcatctctctacttctacctttacatcctacattctaacttacattatttctggctactgttcagaactctcaaaatctcctaatctcccacaatgtacaagccaagacctttacaatggtcaataaggccctatctgatttgtccttctaataccactccacttgcagatcctaccgctcttcctcagtcactctgcaccagccatcttgactcccttgttatcccacaaacacgcactccctcctcagagtgtacatattcttccctctgcctagaactctcttctccaagacacctgcaagatgccctcctttccttccttcaggttttttgtatgcctcttaagtgaggcttttccaggacccactacataaaatggcaacctaccctttgaaatatccctattctacccttatcctgctttattttttctcttagcacttgtcactctctgaaattctatattctacttgcagagagaaaaaacaaacaagttgacaaacaaatatagagaacgtcagatagtttgctaaatgtttccctctttggtttagctcgctagctaacagggccttatgattaaagggacttgatctcttaactgttatattcaaaacactagagcacctgatatgaaatagatagagaatgtagacttcatgtgtatttctgtcaaagcatgtttccttaaatataaattatttgtaaaggataagaacttcaagtacagatatgatactcaaaatatttattctctgactgacataataactgcaggtaattttaataggactagttcctatgaaaagtactctccgtagaccttgtagatcgaagacatttttttttcttcaggccaggtaaactaaatcaaagaaagaaacatttagcaaattcatctgcaactctcatttgttctcattaaaagacagctaatgctaaaccaaagagtaacttcacacatttctaatgaaaaggtctcttagtttgcactcatcacctggccacaattctggacaagaccgaaagtgatcacttgtttattgatcactttttgtccatttttactattacttatctctgcatatagaactggcatagtgaaattagctaaattaggatacaaataagcaaagcccttttaaaaaccatactctgccttttatgttccaagatacatacaagtctgccctccatgtgcattacaagaaaggtttctacagttaaagttatatcagtacattactgtcagagtagatcttaattctttgtgttctggctaccatgatcataatttgaaatataattctaggaatccataggaatcttggtaaggttaaaaatgcaacacccttaagtgaagcacagaggaagaccttcagagtgtcactaaaatgaaatccttctgctgaagcaaagtaaagcacaaaagagagattgaaagactctgtaggtcaattggaaatgttttattcttaagaaaaatatatagtagcccatgaaaggattgcagtgaaagaaatttgcggatacagtcaatagtaatgccacaacgaactgtttttttctaacctttgaacacaattatattaatatctttattcatcacctatctgccctgaaacacaaaataactaggattgttaaaaatatatatatacatcagataagtatttttaagtcttataacctaaaacaactatatatacgtatatatacgtatatatacacataaatgtatacgtatatatatacacatatatgtatacgtgtatatatacacatactcatatatgtatatatacgtgtatatatacacatactcatatatgtatatatacatgtatatatacacacgtatatatacgtatatatacatatgtgtatatacacttatgtatatatacgtgtgtatatatacacacatacacacgtatatatacacatgtgtgtatatatgtatatgtgtctatatgcatacacacatatacatatatgtgtatatatacgtatatatgtatatatatgtgtatatatacgtatatatgtatatatatgtgtatatatacgtatatatgtatatatatgtgtatatatacgtatatatgtatatatgtgtatatatacacatatgtgcatatatgtgtatatatacacatgtgcatatatgtgtatgtgtgtatatatacacatatgtgtatgtgtgtatatgtgtatatacacatgtgtgtatatgtgtatatgtgtatatacacgtgtatatacacatgtgtgtatatgtgtatatgtgtatatacacgtgtatatatgtgtgtatatgtgtatatacacatgtgtgtatatgtatgtgtatacacatatgtatgtatgtgtatacacatatgtgtgtatgtgtatacacatgtgtgtatatgtatatgtgtatatacacatatgtgtgtatgtgtgtatgtgtatatacacatatgtgtgtatgtgtgtatgtgtatatacacatatgtgtgtatgtgtgtatgtgtatatacacatatgtgtgtatgtgtgtatgtgtatatacacatatgtgtgtatacgtgtatatgtgtatacgtatatgtgtatatgcacatatgtgtgtatacgtatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatacacacatatgtgtatatgtgtgtatatgtgtatatgtgtgtatacacatgtgtgtatatacacgtgtgtatgtgtatatacacatatgtgtgtatacacatgtgtgtatatacacgtatgtatgtgtatatacacatatgtgtgtacatgtgtatatacacatgtgtatatatacgtgtatatatacacaaatgtgcacatgtgtatatatacatgtatatgcacatatgtgcacatgtgtgtatatatgtatatatacgtgtatatatacatgtgtgtatatgtatatatgcatatatttgtgtatgtatatatgcatatgtgtgtgtatatgtacatatgtgtgtatatatgtacatatgtgtgtatatatgtacaaatatgtgtgtatatgtacatatatgtgtgtaaatatgtatatatgtacatatatgtgtataaatatgtatatatgtacatatatatgtgtgtatgtatatccatatatatatatatacacattttttaaaaaataggtataggttgagcctctcaaatccaaaaatcccaaatccaaaatgctcccaaatcagaaaccttttgagggctgacatgacacacaaaggaaatgctcattggagcattctggatttcagatttttggacttgagatgctcagccagtaagtataatgcaaatattccaaacgaaaatccaaaatttgaaacatttctattttcaaacgttttggacgaagaatgctcaatcagtatcagattgattgattttgagtcttttaactcattcagtttttgagtatagtccccacaaaataaatcccaatttaaatcaagtacttgcattgattctcaactggaaaaaggtcattcccctttgagggttcaataaattcctcagtggggtttcctccaacattctctactacagacctgattaaattactgaaattctaacactgtggttctcaaagtgtggttctttggccgtcagcatcagcatcacctgaggacctgttagaaatccggattcctgggtcccaccctagacctatggaattagaaactctgactatgggcctcagcaatccatgttttaacacattttctaggtaattccaatgcgttttgctgcatcgttttggagtgtgcatggtatcaaacaactctacaaaaatggtagcctgcttgcttttccattttaggtctctatgtctattgccaaatgtaaagggtagacttcagaccaaattttgcatgaagcattagtggtggtggggcagtctaattcttctatcattgcctgttgttttagagcttcacagtcttcaatcagaagttgcaaattaacatgactaagccattatcttattgttggctcaaccagccccacaacaatataattcttcaagaatggcattatatgccctctcacaacctctcttcttcactcctaaagatctcccttgctactactcacctgacaagtcatacttctttgattattacacatttctacatgcaattccttctgccttcatctttcttgaaattgtctctgcgtagacaacaccagactaaatgtcaccatattttaaaaagctattatcctctccaagcaattagtcattctgtcttctatgttcccacagcatttctattgcattaaagattatgttttattttaattatttgttgatgcaattgtttcctttctcagatgataatctcttggagagggaaaaccatgttgggttatgccttcatcactgtatgacagtatgattagcacatagctggcattcaataagtatttgttaaatgttgaaaggttattttagtaaacatatatctctgataggatggtaccagagtgtcaattgttcttttctaaataaaaatgcttcactaatgtccatgtatgttgttttgctagaaagcaaaataaaatcagataaataatggataggcccatcagccataaagaattggtttttttgctagcaactatcatgctaattggtaaatatttacatatgcaagctaaatatgcttggcactgagaccactccagagaatataggtgtaatcaataattccaattttcttgtatcaggacatgataacctagagaccaaaacatttaccttctaaaaggaattgtcaagatctcagtaacactgggttgataaacagcaacatatttctaagaaacttctttactattaacaataagtgatttgtctttctttgaaaacagtgagacctatcacaatccatttttgtctcactaactgagtaatatcctttgttacttaggtactttgcaaagattgtttcaggaaaacattcaagggaatggttctcagtagattaaaccatttagtataatcatcttgattccaaacacaaacacatcattcgacaagtcatcttaacaccaagtgtagatgttagggagttcacatgccagtaaagtggtattttgaatttcgtataaaactgttttaagttaatattcaaataatcatgtaaacacaataatttgtttatgagtagtagaaataaaaagcaatgtttgaaaatgacaatatcactttagataactctactgcaaactaagtttacttcactcaccaaaacgcagtatgtaaaaaatattaacatttaaagtacaaacagttctcgacttaagatattttgaccttataatagtgtaaggtgatactcatttagtagaaaccgtattttgagtacccatacatgcattctgtttttcactttcagtacagtattcaatcaattacatgagctagctttattataaaataggtttgtgtgaaatgattttgcccagctctaggatagtgttaagccagcacatttaaagtagggtaggctaagctatgttgtttcgaaggttaggtatattaaaggcatttttgacttgtgatattttcaacttatgatgggtttatagggacctaaccacacaagttgaggggcatttgtattagaaatcattcagaaagaatcaactaaaaaacttcctaaacaatggttgcattttggggttactaaacattcaaaggtagattaaatcctctgtgagtaagcgagcatttaataccacctgttattgagtcttcactgtctccaacccccctgcctgcttctcataggacttatcaatttgatgatttgtcccaaaaatgcattattgggtaggtggaatttttgtcccaacaataataggtatggaaatatcatgagttttagagtccattttcttgggtcctagcttcatctctcctatttactgtgagcaagccacataaattcacattttactcatcttgaatacttgtatcatatgattattggagcaactaaccatatacatataattttcagtaggattattaacatcatggtatacataaacaaaaagttcccaatcctcactatttctgaaacgaggatttccgtaagtttcctgtatcaatattcatctctccaaaataattgcactaaataattcaattgttaccaaagtcttgtgcaggctgctcatcagcatccagagacatagttcactgtacgtcatctgctctaatgatttaattcttcctattatcagataaaaacaaacaggaagccaggggcacaggagccattttagatctatgtaaaaccttccatggcacaatagctctgctcgattacttctgttaaagcaggcacattgcacaatagttatatataaatgtgttagctatatacagatttagaattcacttacacaatggaaaggtacatatatattgttacctccttcactgaaataatgttttgccactttgtcccagtatcatccttttttaaaaacttctaagctcattttaaatatagaatatgtttactgggtgtgtgtatatgtatgtgtgtgtgtgtgtgcgcgcacgcgcgtgtgtgtgtttgtgtgtacgtgttgaggacatgaattggcatacagagtgtaataggatagtaacacatgaataaatgctctgttttccctgtttgatgccaagaaggtagccaaaaccataatcaataaagaaatgaacaagtatccagaggaaaatcacccttcaaaaactttagttctgaaaatctagattcatgttaaggattgatatattgtcccaactgaacaggctattgggatatgggagttaagattcggggacagtggaaatttgcaatcagtcagattaaagagaggtttaatgagcttcctcaaacacagggaaagggatgaagttgtgaaggccaacatcctactccctttacagagtttccaaatgttgtgctgagacaacctacttaaatggctgtagaggccagataccaagcacagagcatcatcagcaaaaccttccgtgttcaagcaaggcagggcattgtggacaagctgtcctttatgtagtcatgtttacttggctattaagcatatcagctatgaccaaaatgcactgaaaaccaggacacttacagtattctggactctacctggccctttggaatggaagtgggaagaagtagaagaatgcaaaatgttacggagattgaatttctcaccagtcagattgttggggttactagttgctgcaggaacagattcaaccaatgtagagaaacaaggaaatatggcttattacaaactaggttatagaatcaaaattcatgtgcatttcaatagcatcatgaaattatggagttaggaacacaatgattacaattaaaatatcatgttctcaagaagaccaggtaacatcatggaaaagaatagaagtaaataagaaggagagattcagtagaaaaaaattcataaatatatgcatttttcaattcaattcagaaaatacattacataatgacaaaaatgggaatattttgtgtttatatgatttactatttataatgcccttttattatatgttttgttacaagtaggcaagaacatataagaaaaataagactcagagaatttcaattttatattcacctttcttttcaaataaattaaagtatggatataacgttttctcctaaggtagagagtagtgtgaagaagcctgctttatcaaaaaataacgtgctggtggggctgcggagaaaatggaacacttatacactgttggtgggagagtaaatgagttaaaccattgtggaagtcagtgtagtgattcctcaaagagctaaaaacagaactaccattcaacctagcaatcccattactgggcatgtacccagagaaatataaatcattctattataagacacgcatacatatgttcattgcagcactatttacaatagcaaagacgtggaatcaactcaaatgcccgtcaatgatagactggaccaagaaaatgtggtacatatacaccatggaatactatgtagccataagaaagaatgagatcatgtcctttgcagggacatggatggagttggaggccattatccttagcaaaatgatgcaggaacagaaaaccaagtactgcatgttctcacttataggtgggagctaaatgatgagaacacacggacacatagaggggaacaacacacactggagcttatcggaaggtggagggtgggaggagggagaggatcaggaaaaataattaatgggtactaggcctaatatctgggtgatgaaataatctgtacaaccaacccccgtgacacaagtttacctatataacaaacctgcacatgtacccctgaacttaaaataaaagttaaaaaaagaaaggctaccttactgactcaaaagtttagtgttaatttaccctacatcatgcttatcatgctggctaaaaggtaaattaaaaagaaatcttgcaagaagtatgtcatatcaatttattttatcacatgatattgcccaaagagggtgagtcctggatttttaatgtggacatatatgttgcggcaatgaagaggtaaatgaactattgtggcaggccaggtctcactaatgcaggcctccacaacaactgtttcagcactgactgagtggtaaagttacatattaaaagctgatagagccagcgcccttaaacaaaggctggacggtaacaaaagcccaccaagagttttgcccaggcctttcctgggccttgaagcatgacaagataatgaaggaattcttaacaggacccttttagaattaaaaaagctttattgggggtctgaagaaactccccaggactccacaaacaagtttactgggcatctgaaggaactcccccaaactccatgatttagccggagataagataagggtaatcatcccagcacctggacccatttagataaagtaaatttactgaggctccagaggaatgtcttcaggaatcagatcttagttacagatcagaagaagttaatcatttatgtctttagatggatacacacttacatgtagacatacagcgtagaaggtatataagctctggaaaactttatagttttgagttggtctggggataatttccaggtcttctccctgtaaccacttacagaaataaaaactctctccttttcccgttcatctgcatctcgttattgggccacaagaataagcagcccaatcctcagtttggtccaggaacactatcatatcatgggcttttgtgaagacattagacaaaactaattatgcatttctacttcatttaagtcaaacatgcatactatgttggaaaaaaatcagacagaagagtgagtatggaaataaagatgattactaaattcagtataggatcaaaaccatcatatcactcattgggagatagtttatctctctcaattgagctggcagtaaatattttttcccataaaattttttctcaaacacaaacatcaagcacattttatgacaaaattatttttggtcatgttttcaaaactgtacttccctttattaagccggcatggatgagcaagatttttataatgcgaatcatatttgtcatagagtatacacgaggctttttaaaggattataacatatcaataaattacatggaaagaatatttactctgaattaatcttatctagaaatggttttgtgtttatgtggagataaatattgttcagttatctctatataatagatgtgataaatcacattctagtagaattttttggaatcaaagttaatagaagacttattttaaaaagagatagggcttatttttaaaatggtaccaggaaagtggaaaatcagttagatttactgcaaagacacatttggcttcaaatgacgccacaacaacaaggatacatttaatcacatttatttcctttaaatatcccttccgtagctttacaaaataacaaggaaatattttgttgtctctctataatttacaaatattatataaatgtgtgtataaaaggcaatgaaaaattatcatctgtctgtgtggtaaagtagacacagatagacattaatacgactataaaaatgaatatgagttagatttattagtgaggcatttttatagttgtatgaatgtgtgtgtgcctgtgtctaatttaccacacagacagaatttttcattctcttttttctctttttaaagtcttcttcaacacaatttttccacccagtttttcttctgtttctacagttagcatagatttaatgatttgtactactgacctagtatatttattatatttatatagtgtactagtaataaacaatgagattatatagaagatatacattcctgcctttgatgggctcacattttagagctttcttcataaaggttaccagattccctctagctcagattactgccttctcagaccacccacactgagcccactcagttctaactccatttatcaattaaccaaaaactcccaaataactgtgtaggttccatgagttcaggagattccacttcaactaatctgtgtatcctacagggctagaattctgctgaaaggcatgcagcgatgcaataaattgccaaatgatatatatatcacaattatgtttatcttttggtttcaccaagtggcttaaactgaatcaactagcttcctctaaattcccatcttcttcaaaagtgtctaaaagaatgcagtcacttagctaagttttgacagaaaagaataagaaaagaggaaaaagattctttgcaagttctcaaaattagaagttagtgcacaggtatatatacattttacctttaaataagttttctcctctgtctttgtaaacttttatttctattcctgacacctaggatatgcttgataatagaatttctgtacttgaaagaatggtgactctcctgatcagttataacagacttagggagaacatttgtaatataaatgaaaagtgtgagttgagttagaggatgcaaatattttggaagaaaacaataaatgtgctcatatatgtgaatattttacagttttaagatatgggcattcataaggacagaaaaaaatataccgaattgctctgaggcagtgctaacaatatataaatagaggatggattggatatcaagctttgatttctatattaacaggtgagttgtgataaatgataatggaaaaggttaatgcacagagcgaagatctatttcaacttgcgggaatgaggatacacagtacttgtcatgtttacacaccttttaaaaattactctagttcaattcaaagattcagagtattgttacatttactatttcagaaaatttcttcacaattctgatttgtctgtatgtttgtttgaaaatatgtctcttgtctgcttcagaattccaaaacttaaaaatgtcaatgatgccagtatatacagcaattaaactatatataaccatcttataaatattcggagaattatgaataactttcctaaatatcctaggtttactttttatttattcttctatatttgtgttgttatattttatttcacttagctaaaaaaagttgaggatttaaaaaacgtttttaaaatacatgtttctgtttacgtctgtaatagaaatttgttaattattcagcaagtaaataaaatgaacttttattagttaaaattcagtaagttaaattaaagagtacatggcaacattctactaccaaataccacaaagaatagacgatattctaaaaatgtttgtcatagaaaagggagaacttttgagattggatctcctagtggattgttttggctccattatcatgaattttacaaaatcagacccatagagggagtaattcatagctattaagagtttcaggcattttagtagaaattttcacttttagtgactctttaaatcattacaataagaaacaaaatatccactatcaaaactatgccactcttaaagccttgggtttaagggccatattttattagctttatttttccattatctagatttgatgtctcaattaagcaatcaatatatacatatacaaacattcatgatggaaacataagaaaaccgactcaccaaacatttgattgatttacccaaatcgagaataataattaaaatgcaagtcttttaaactttgacatcccaataaacctccatatattgcattcctaatactagttttcaaggtaagaatatcttgctctgtgtccacctataatcatctagagtcacgctattgattaaaaattgagttgtatttgcaaattaagtaaatattaagagtatggattgaagcctgcacaaaaacaagatgaacttattgtctttaatcatttgaaatatgctctaaactatagtggctgaatacacccaaagcaattatattgcttttcttgaacttggtaaagaccaagagggacaaaaaaatgataattttcacaacaaaattccctcatatcttcttctgctgggtgacatattctagctacttgatggaagattgcagctataaactctgaggactcatgtcattaaagaaactcacattgtcaagaagaatcaaagatatacattttatataattaaatagtgtatctttgccatatcttctgctgcttactccttaaataagagtgaacataatatttccagatttgcacagctaaaataaaatgacactatgagagaaataaaacggatttttaagatacacaggtacatagtccattttgaaaatttcacaacttagatcttaaaagtaaagtaacaaaccattcttaccttagaaaattgtgcatttacccattttgtgaatgttttcttttgaacatcttctctttcatctaaaatgcaaaataaaaaaataaaagttaggaagcaactttaaatataattcatattttacaaccaaagtaactttccattatgatgtgttagtgtttttttacatttagtattacattcattgataaatggaattaaacatgagtgatgctggtttggggcatccaaattaaaattacttctgaaaaatggccaggcgcggtggctcacgcctgtgatcccaacagtttgggaggccagtgaggacggatcacttgaggccagtagtttgagaccagccaggccaacatggcgaaaccccatctctactgaaaatacaaaaattagccaggcatggtggcatgcacctgtaatcccagctacttgggaggctgaggcaggagaatcatttgaatccaggaggtggaggttgcagtgagccgagatcatggcactgcactccagcgtgggcgacagagcaagatcccgcctcagatttgtaatatctgaaaaacaattaatatgaccaaacccatagtcgttcaaatactgtatgattataaaaaaatagtctcctctgaataacagtatttattcgccagttatgaatagatactccagtataattaaaagaaactctcagctgtcatttactccgaaaaactatttcggagcctttccccatgccatccacccaaccatggagaaatgattattccttcctttgcagcatctacatactctaacatgggcctgatctcactatggaagaggtttcctgatgagcaggagcatggtttagttatctttgcttcccagaacttagcacactgtctgaacaaattaagagctcagaaaatacatctgacaaatacgtgcatgctttaaggaaggggagattctacaactctaaaatttctaggacctcttttcatctaaaagtcagaacatttcaaataaaaatgcaaatgatactcttcatgccttacatataaatactcaaagaaaaaagtccccaaagatttatactaagggattagggagaaaaattattaaaaaacagcttcactgaattcatgcttctacaaatgatctttttgcccctaaactggaaattagtattaagtcaaatggacagaaaaatcatcaatcttgatatattaaaatgtttttctccaagcaaaagactatttttttaattattgtaaatataatcatattagttaatgttcagtaaatgaatgcatctgagagatatttaaaattgataaattttatattttatctacttggattaaaagaaccgttattaaaatgccctttacaaagtaatcatatttgctctcatatatttttcagtagtaaatctccgttgcttctcttaaaaacataaggaatcactttcgcataacaaatatatgcatgcaccaaaaatatctgtttatctttaaatcacaatactaatctataagtagattcctttagtcaatatgagaaataacagtgaataaataaatttcaaactgtcatcttaggtgagaaattttatttagcattacaaaatacatttttcttatttaattatgttattcacacaagcttctatatgtatgttcaatatcaacattattcatatggtatatgataaatcttagctacaatatggaagtatttcctttgttgacaagggtgaataaataaaaacagatagtaatagttttcaaacctattctagcctccttcaaatctttactttcataaaattaatactagcccttccaaaataattttaaaaagaaatggaacatttcaaatggtcaaaattaaaccatcttcatagactttatggaggaagattggtcaacgcatcatttatcagtagtatatacatatattcctaaaagtaaatgaccttatttgcaattccacttatatttcctacatgtgcatgcgtactttctgtcagaaagcagagagtaaatgagtcagttgaaagcatacattcagatgtctttgaaacatacccaaaaccctctgccaaaagctcaatatgaggtcttttgaagtgatttaatctagaggcttttaagtgaaaaatacgtagtagaataaaatttttattcttttcaattatatggacaaggagtaatttttaggtaagcatcgaaggcagcacgaaaaccttgacattatgtgcaaagtgttacttatttactgtgtaaataacactaaatgtgagcttcaacatataaacatctttgctagttgtcctctctcacctctacgtctttaatacaagaaaaatgtcttcaatgaattattgtcttattttggtatagtagcatatattttcttcaacataataattattaatacaattaattgtattattattataaaatacataacaattcttagtgccttactattcataagtttgttttaattatgtcttctcaatctgtatgtaatttactactttatacataaacacaagctgagaaggaataaagctattaagtgacagaaatgaacttgatacagattttctgaatcaaagtccatggcttttcacattgaccagatatctatcatttacattataattgcataattaacaatacagaataccataagataatcagagtcacaaaaggtgaacatattaacgcaaatgcaaaacaaccatgaaatcagagcttctattttgaacaactcaaggaggttccatgtatgttgtaacctatgtgaatagcgtcctggaatttggcaatgcataacttatttgtctgtatgaactgatctagaactgaataatgagccttctttaatggtgctggatgatatggttgttaatacttcaaataataatgcttttacatttactaattgatatttggtatttcaattttcgtcttatatatcattatggaaacattttaacatccaaaaatcaatcaaaatttttgtgtccacacttttaaattccccataaatacatatttcttataaccaaaataatattctttctttttcacttattttatcataaatctcatataagctgctctttccttttgtttgctattagagactaaatcacaataaacatgctcatgcactcacttcttttttgtttttataattgtcttcgaaaaaattatcagttcaacattatgaaaacctttatgacttttgctaaatatctttataatactttccaagtgatcacacccacttctactggtagcagaaagaatgaggttgggaattatcatctcagccgcaggtatgtcattcataggagtttcgttgctttagtcttttacggtattgctgctttgtttagatgtaaggagatccttgatgtttgctttaatcataattaatttgattactaatgaagtagaagatgtttcatgcatttatttattctgtatgttcctatttttgtcaaaatacttgtttacatcctggctcatttatctattgagcatttaatattttaaaattaattggaatgagataattatatattggtaattcttaaacatttcaagtcatgggctccatttgattatctgatgaaaataatgaaccttctctatagaaaaatgtctacacatacatatttgcatatagtttcatagagttcactgacctccttgcagaaaactcctataaccataaaatccaagttaacgatcaaaattaagctactcacttttagtcagtgaatggacatattttcccaagtggtcatatgccttttaatttttattttagtatgctaaaattttatacgtatttacttgaattgatatatttttattgctatttgtcatattgcttaaaagttgactattttaagctgtatacccttagttaacctaaagccaccatacatacacatcacacatatataaattgttctagaaactattttgatacgttaacatgatgtctatttctgtagtcacatagtctatagtaaaacatattaatgtgcaatcagcaacaaagcaaatgagaaaagaataaagtgatagctgttttattacaaaatgattatatgctcctgtttagtcatttcaagcagcacatattctatttcatttcctttagggtttgtttataactgattttattttactaataaaaacatgcatgtgcatattaataagagaggcaaagaagaaaatctctcttaggaaaatttacttgaaaactgttccctggagatgtcaagaagtgaagaaccactacttcataaattgcaaaaactgaccaacgttttattttattctctctacggggaaatcccatataaaattagctttctaacatgacataaaaattgtatttcctctcagtaatctttaaccccttctaataaagttatttttattcagtatatgtggcctttcatattttttaagattagtacaatgaacttttaccctgttattaacttttatattccttagtccctcaggaatataaatgtgggatatattaaattgcaatattcttgattcacaagagcaagttactgcagaagaatgatactgggcaaactgagggaacattaaatctgtggaactggcttccagtggctttgcaggacttattagaattgtggccttaaaattgccaagccttagcgtctttaactgtgaaatgagaatattaattgctctttaactcatggagctattgacaggatataatgagatcatttactcgtgtaataatttataaaataaatatttacagaatgcttactatgacctggacattgcactagttactgaaaatataaacaagattcagtctgggagagctcttagcctagtagataatagacacatcatagataaatatgaaacattttgcataaacaaaaatatatataaatttaaagcgtattataggagcatggagaaaggaatatgtagccacatgggtgttagaaaagatattttggagaaggtaatgggtaggttgagttcagaaggatgagagaaagtaaagaaggaataaaggtaggaggaggataaagatgaatctcactgagcagacagtaaggacaaggacagagtgataagaaactgaaagtacacgctcattcattatgcaattctgttttgttgcactctaaaatgtgagaaagggagtggcatggaatgaaattgcaatgagagttaggagcgagatgctggagagcctccttaagacctcttctctgccatcagataaacaatgtaagtgaaagcatttaaaaactgggggaaaaaaaaaaacagaaaaacagttctataaacactaacaattattcccattacacaaagcaattaaccataatctgtacaagaaaataaaatttttttgacacaaggtctcgctctgttccccaggctggagtgcattggaaccatcacagctcactgtaacttcagacccctgggctcaagcaattctctcacctctgcctcctcagtagctaggactctaggcacacatcaccacatctgtctaatttttaattttttttcttttgtaaagatggggtctccccatgttgcccaggctggtctcaaactcctggactccatcaatccttctgtctcagcctcccaaagtgctaggactacaggcatgagccaccacattcggcctagaaaaacattttttaaatgatatttccttgggggctagttaatatgttaattgaagatcttcatccctaatgtgacacagaaaatgtatctttaaaaggggaagggaatattaaagttgataccagtttagaaactcacgtagtgaagaaatgcaatgggatgagttaatttcacttaaagaaagaactatgaagccgggcgcagtggctcacgcctgtaatcccagcactttgggaggccgaggtgggcggatcatgaggtcaggagatcaagaccatcctggctaacacggtgaaaccccgtctctactaaaaatacaaaaaattagccgggcgtggtggcgggcgcctgtagtcccagctactggggcgtgaacctgggaggcgcaacttgcagtgagccaagatcgtgccactgcgctccggcctgggggacagaggagactccgtctcaaaaaaaaaaaaaaaaaaaaaaaaaaaaaaaaaagaaagaaaagaaaataaagaactatgaagtaatatgggagagcaattaagttcagtctattctctgcttccatcaaacatgagaaaaaaatgaaaaatatggaagattaatgataaacattagataaggttatgtgatattttggagcattataaaggaaggaaacaaatttaggacatatttagaaagtggatttactgtgccattaatattacaaaatggcagtgcagagtggaggaggctgcaatggaaaatggtatgaaaaatgctttctattaaatctgagtaatagtctttgattatgggatttttctaccgcctgaggtgacgttagtggtcagcttacaatgaggaggtctaaaataattaaacttctgcacgaagaacagaaaagctgttcatgtcaaagatatttctttatttcccattcgctttacagtcaatgtaatgcagtcttcactgctcatcatcctacaaaagttgttcttaataacatcacctacatcctttctcatttccaagagagtgactgtctggatcagagctgtaatcccagcacttagcatagaatgtgttacatagtagtgctcaataaaggtgttttaagttaacgaagaccagatttactttttagtcctcttctcatttttctcctctgcagatattaattctattaaactctggtaggcagaataatgcctcctcaaaaatggccacgtgctaatccctgacatctgtgaataaattatgttacatggcaaagtggaattattgcagatagaattagactttctaattagctaacttttgatagggagattatcccagattatctgagtgggcaggatttaatcacaggggtccttaaaaggggggaaatgttggcataaggggagaattagaaagcactatgagaaggacttggtccgaggtggctggttttgaagatgtacgaagaaggccgtgagccaaataacgtgggaattctctagaaaatggaaaaggcaaggagacagattctcccctggagcatccaaaagtacacagcccttctggcatcatgatttgagtccagtaagttccagtttggatttctgacctgcagaactgtctgagaataaatgtatataattttaagccactaaatttgtggtaattttatagcagcaataggaaactaataaattacatttcatatttaaggctattaagtgacaaatgtgtactgacacctactaggtggtagaaaaacaactgtgagaaaggcagtgtctctagcttttttccttctagcttagtgagagaagcagacacaacaaaagggtatgttgatacaaatatacagataagttgcctgatgaagaaactacagtcatgtgacaatcatatattaaggaaactaccttgaaaaatccagagcttccttgatgaagtgacatctcagctgagttttgaaagttaattaagagcagagagacaagtggtagaaaagagaactccagaaaatcaaaagagcaggtgaaagtgtcaggatgtgagagaaagagtatggtcctttcccagacctagagatggtggaggaggataaaaatggcagagatgaccctagaaaaagtgaaattatcatcaacctatttatgaagagcctgaaaatatagccagagggcagttcgaaatcaaagcagaattttaagtagggaaatagcaatgtcaggcttggcttttagaaataaatttcacagtgtagagaatatttggggataaactgtaaataagaagacacatgagctgattatacctataatccacgtgagaagtaagcatgacttgcattaatgaatggcagtggggctggaaaaggagtaggtgcattcaagatgtgtttacggggtagtattggtaagtactaattattaattatatgtggagttaggggagttggatcatggataatcaatgataaagctaaattccctgatggagaaactacagttctgttacaatcatatattaagagaactaacttgaaaaatccagagcttctctgatgaggttacaggctagattattcagaatggcatataagggccttcacaatttgactccagtgtactcctctaaacatattatcgattaggcctgttggcagtcacccatatcccaaaccttatatacatctaccaggtctgccttagtcacacaagccaaatttctccataaataaatcatatgctttcttgctttagtcctttgttcatgcactccctagaatgaggacactcactattaagatctaggtcgaatgtgagggttttcacaatcacacttatctccctggcataacttatcaatcaatccttctgatatatacatatgtgtaggcttttttctaattatgcatatgtgttacacacataaatactttaactgtatgtgtatggacacacagatactttaattgtgtgtgcattataatttataaagtgatttcaaatatctcatcttgcttacactcacacatacacacatacacacacacaaacagaaaattagtttgttgtcttccaataatgcagcccaaatcccactcattacctcctaaatgtgaccacacttagatgggagaattattatgtctttgcaactcctggcaccaaacatggtatactgaagcagaaataggtacttagtaagggtttgttgaataaatcaagtgactaatcaatactgtaattaaatctcagatctactaagtcctagaccaatgctttccccctgcacttcatcatactgctcaaactactctgttaattatagaccttctgtcaccaattcatttcctaaattatccattgagcacccattagacataaaactaactttcaatgacttctccccaaaatttagccttggaactgaaatattgctacttattttcatcactacaatgaataaaaaattaagagaaagaatatttcttgcaaacaatctgcctttatttctctaggtgaatttcactctgtaatatgatataattgccctttacttcatctttcatgactgtcatgcttctgacacaatgtaaaatgctatggatgacctgtctgttcctttgcctccactgcaaacgccacttctttctcaggtaggtcaattgcttttttattgtagggagttgttggactcagaaaccagattggaaagccatgtcagctcatattgaataaaagttctctcccattccctgccacttaatcacagaatttatgctccattagcaaattggagttatggtgagaacctaacataatcgcatagttgtatattcataaaaattgcaatgctctatacattggaaacatagcacaagtattgtagaaatatacttgtgaagaattaatcgaagttgcatgaagtaggacataatgacaatgagattgaagaaatgtattagagtggaagaatgatcagaactccaagagtatatgaaaaggtgttaagtggtctcagttggaaaaacagtgccatctggtagattgtgcaaacagttaattcttatcctcttaaaattgcatgtgttagatacaatgcaggccggggttacatcatacactcatttcagagtcaaataacctgagttccaactccagtttcacatctcattatctctgtggccttgagtaagttacttaacctctctgtgtctcattgcctctatttgtttcatggtaatagtaataaagatactgaattgtgaagactaaatgtgacacatgtatgacatattaatgctgagaaagagaaaaaaatagacaaaacctataaatctttacttccaaatatattacaacttcccgtgggtcttctgtataaatgacattatttcataaaatagacacgattgctacgtggcagccatgttaataattagtaggatttttatagtatttgtaaatatgcaaaaaattcaagtcttctcgatttgaaagataaaaacaaaatatgaaatgatattcacataaattatacctcctcatgctcaaaagaatgaagtaagtttttagtaataatggaaataatggatatttctgtggtgcattataatttataaagtgatttcaaatatctcatcttgtttaaacatgagtatgtgggtgtagacttgttaggagtaaaaataagttactattaattagtatgcagacttgaaatgtgctttggtagtgttcatgagaaagatgacttatttttgttaaagtaataaccatagactaattatgacagaataaatcaaaataaggtcaaggtctccagtgtaatttagaggtgaaattaactacttggatattgtagcagaactgctaactagatgcctgtttccatacagctgcctactcaatattacttttaaaagattcaaattctcccctgaaaatttaaaaaaatacattgttctgtggtgtatatttatctatttttatgggttgcaaaatacttctttgcaaaccaaaaggaaagcaaacagccaaatgtgcacgacacacaacagccatttccaaacatactgttaatgagatgctttagaaacagacaaatggtcaaacacagggcctggattataaggggatatttaaatcacaagatgtatttactcaacttacactatggagtaaaggttaataaaatggcatagtagatgaggataatgcctcatcccttatttcaccgagccatccctgagttcacctataactatagtgaacggattctgtggatgctgaagattcctcaccacaagcatccacatctctctgtttctttgtgttaaggctttcttcagtttaggagggcttggtaagcccatttgcagggcagtccagaagtgatagagatttagttctcccaggggcaaccctcaataaacgagggacagaagtctatgtattaaaaaggacaaaaaaaaaaaaaaacaatggaacaattgctaagcatgccctgtagggctcctcaattgttgcatgggatatgtaatccagaatggcccataggagcatcgttattgtctgctctctgtagtggaatttgggcccacatttcttggcttgatcatgcactagttatgcagtgttagaaaagactcataggccgggtgcagtctctcatgtctgtaatcccagcactttgggaggcccaggtggacgcagcatgaggtcaggagttcgagaccagcctgatcaacgcagtgaagccccgtctctactaaaaataaaaagattagccgggcgtggtggcggacacctgaaatcccagctacttgggaggctgacgcaggagaatcacttgaacctgggaggctgaggttgcagtgagccaagatcatgccactgcactccagccccgacaggagttcaagactccatctcaaaaacaaacaaacaaacaaacaaaacaaagaaagaaaagactcataagccacaccaaacccaagatttccagtctgaaaagaggaaataatcgtggtaaaaaaactcttagcttcactttgatgaggtatcctgtaaagcatcgaaagtagtcttaagcaaagacttagtacaaagtaagtgccaatagagatcagtattattattcctgactatatatttaattgcattagaacttcttgaacaagttggtagtttacattatttgctcatcggtttctttttcttcctcctttccacttgccatggttcaccatgggtggattacacatcccactcactgatgtggccttggtcatgtgacttgccttgaccagtggaacacagtcagatatgagagtgtgtcaattctgagctaggggcttaagaatcataaagtgttttcacttttcttggtccttcctccctttgtcaggggaagtacacgcctcaggtagcctctgttcctaaaaggagagatgcatagagctgacctgtactcaatacaaaattgaacctgacatgtgaataagaaataaatgtttgttcttataagtcattgagatttggatttgttttttacagagcattagcctataataaagctgactaatatagcaggtaaatagtaaatgtggcccatagaataaaattcaataatgatggaatgtatataacctcttcatttaaaaaagagagggttgtattccatcattaaatttaaaataagctgaagaatgggttttaaatgaagtattaaaagctttccaaaaattgccctttcagaatatattatcttttaaatcttggtctttctccttaccataccattcaaaatttaaacattaaaacaagcaggttgttctcatacatggccaagtattagcacagacagaaatcaatgtagaaaacaatttaagtggaaaataagttttaaggaaatgcagtgagttattgtaatagcaatggtcagtactgagcctgctcatttccaccttgtgccaaatactgaaagcacttaaaacagaaataaagtttcggagtaatcattcactccctgttcaccaaatacggaagtcttaagccagtgtttatgaaagatcaagccaaaaattataaataggaatgaaggccaaacatgttttcagcactgacgggaaactttgcagtcagtaaaagaacattagagtcagtcttttagaaaagggtttggaaaattattactgagaatacaaaagaaatcctgggagctaatcaaaagaggagacagttttgagagttaatcaggtgccaatgctaatagattatccaagtggcagagcaaagaaggtccagagtcacacaatcaatttttattcagcttgagttgctaatactgatgacaagtggttaacgactgcttcttccaagattcttaatgaaagacttctcttttctcaggtttattatgccactggattaaaaaaggtatttatttctgtactaagatcggtgacaggactacaccgagaacacgtccctcagtgtacattgccaatagatgagttttgtctatatcttgattgactaatcatttaatagatgtgagtgtaggttggcatgcaaattaagtaacttttggccaggcgcggtggctcacgcctgtaatcccggcactttgggaggccgaggtgggcggatcacaaggtcaggagatcgagaccctcctggcaaacacggtgaaaccccgtctctactaaaaatacaaaaaaaaaaaaaaactagccgggcgtggtggcgggcacctgtagtctcagctacttgggaggctgagacaggagaatggctgaacccgggaggcggagcttgcagtgagccgagatcgcgccactgcactccagcctgggcgacagagcgagactccgtctcaaaaaaaaaaagctctcatactagccttattgtttgcacttaggtatcactgagttgaacttgtagaggaaaatataacagaattacaaaagatttagacattgtagaaaaaatttggatttttattatataaaacaaacaatagattttgaggttttaagggaattttctgtttcgaaaaacagcattttaagtatagttttatttcatcttcataaattgtaaactttattttaaattctagtcattacaaaagactttaagtcaaatggcaaattgctttcctctatagccaatttaaaatgtttgaatggttatctatatatacatatgtattcaggttgtgttcatatacatattgttatatacatacataagcttcatacatatataacatataaagttcatatatgcatgtgtataattttatattctgatatgaatataaaattcatgaattgtagcacactgaaaacattagtttttgattagagaacattaaaatgattgtaaagtagaatctccagaatttccaaagtttgtaaattgaagacattcgaattttctaatttaaagatttgatcattccgagcgcctactaaacgaattataaagggaatggctttcctgaattacagtaatatggtagttttagctttgaacctgcctatctgggttcgaaaggtagttctgctacttattaacagtgtgcctctgtttcctcacctgtagaataatgataataatatcggtgtagctttgtcatgagctttggatgaatgttcccacttgaaccctggctctaacactaacttgctctatgggcttctgttaatcatttaattatgtggaatacaatttcctcaactttaaaacatagaatttggaaaagataatttctatgtgttccgccagttctaaaactctatcatctgcttctttattctaggtttttgtttgtttatttgtttctgcaggatgcagtttacagtccttgttggagtatgctctggaatcatacggcctggatttaaagtccagttttgccgcttactggctgagttttctcaatttatttacataacttttctttcctttagttttctcatctgtaaaataggtactaaaataataactatctcatagtgtcgttgtgaggactaaataagccattatctttatatggcatagaaagtgtctggccccaaatgagtaatcaacattgttattcctatcctgaaatctatgggctttcaatacgactatggaataaacccctaaaattgtgggcaaaattttatgagtgtgtatatatgagagtccacagtcatcagcagattctaaaagggctccatggtttgaaaaatgttggatgaaaaatatagacattattctggctcttatggatattaatgatctctgttttacttttttctggaacagtggcattaacagcaatagacctgtttttattatttttctttactttgcttttttttacatgtttatttaagagatctgctcttcatctctgtcaccattgtaccattctttttatggatatacacacagtaattggcactgaaagaggtataattatatacactgcagctatgccagagaaagccagggctccttatctggcctagggaataaataatgggttttcttcatattctcttagatattactcttcagccacctaggattgggcactatttttttgttgttgttagtttcttgtgcttccatatacacagatgcagtttcttgtcacccattatattgcaatgccctttctgaaaagagcccagcctttttctgtaatgtactttgacagtaagtattgacataatgtaatacagtaattggaactcagaaagatttgtttgctacctgactgcttaagatattttaatgccttaatcggacacatatttttaatgcacatttttctttagttagagcagcccatgtcatgaaggaaccactcaaatgtggaattgatggttttcacaggatataaaaaacatcatgccatacaagaaacaaatcactcctttctgcatagatacagtgaattcacagcttggaaaccagtattttcaaagcgtggtatgaaagtgtctgagaataaactctcagcagagatcagtagaaataaccagtaaccgctaaaagaggaacattattgattggcaaagtaatccaaaaaagagaaaagatgtgtgtgaacttaatactaaatttagacaagtattcattgattaggaaatcaaaattcaagataaagaaacatcttcagagattaaaagtagtctttcattgtttgagtaacctagctgaggagtcaaactaaaaccaatagattgtaattagtatgatgctttaggataaagttgaataaagagagcgagagagagacagagagacagatgcattatttaccctgatgtttatacaatgccaaggtcaattaatttataaattaaatttatgtttattagccaaattttagaaactagagaaaaagtgagtattaaaagctttaggatttaaagtttgatatatttcctttgcattttccttgcataattgtaattgcattgcacaagtagttagacaccttactttcttcatttaaaataacaggttttccaatgttgttcaaacacaatttaaatatctagaagcattgtcttctttgttcccataaaaattaccgttctgcttttttttggaaccttgaaaaatggtctcataatttttgctattaaaatagtcttgcaattactatcaatatagataaagcctccacccaaatgtgggattattaccttagaaaagagtctcaaaaattataatggatttaggtgaaaaatcatctccgtaagttttggtacatattttcaaattacttctcaaaaattccatattaaaccacattcctacctgtaatggatgaaaaggtctataacgttgcattgtaacctacattgaatacattaaatagaaatgtaattcatatgtaattcaatgtaattcacatatatgtctgtgtatgtctatctaaacatgaatgcatgtgtgtgtatatatatatatacatacatatacatatacacatacatacgtatgtatttaaagaatttagacttgggtcttagaatcaggctctccctgaatccttcaactgcgagatataaatataagggaatgttggcaatcatggtctgctacatgaggaacagcggaagccaatctgcaataaaaaagatagtttagagagaaggagatgtgacagagagtcctggaaggttttgattgcattttctgaggtgtactgcaatttgccctaacctgccttgagaaacattttaatccttagaataaacgtatcctttggaataaattccacatttgataaagatagttcaaatttggtataagttatttgtagccaagtgtcctaattaatactcaagtaataagtagtttactgcttaacagtagaattagttctatttcatataatttttccatctctcattcagatgggaagttgctctccttcctcttgtaaggtcatgatgctctatatctgcaaactcaagggagaaaaagtctcttaacttgaaactatacaggaaaaaaaaaaaaccctgatgtcatttctagtacttaattggtatttatctgccataaacacatgaagctgttttggtttgttcagttacccttgtctgcatagggccatttaaacccaaattggaattgtctctgggttactatcagtgataacaagaactttcaattcatgccaattataggaattcacaaacacagataggggtgaccaaggaatccaaccagaactttctgtttagtttcattagactcagacttaatgagaaaaaaaaatcattagcactgaaaaacttgtaagtcttgtttagtttcttgctgaaatttaaataatactgattgtgtctgtgatggaaactggtaaagaataaaatgaatatttaatttagtaaggtatacaaaacaaaacatgagagggagcatagctattcctaaatggaaaaataaattggtatactacaataggaagtatgatttccttttaatatgtttgttttatagaagttactaattgcagaaaccattttgatttaacatcatcaataaaatcaatgtgtgaacaatatcattacattcgaaagatgacatgtctaacaaaatggcactatcaatatatatgtatttaaagacagtctccctttaactttgctagacaccaaaagtttaaatgcacaatgccaagggcagttaagtgtcaaaatacaaatgtatcttaatattttatttaaggcttctattgttaaaaataatgcatctaacataataaagagggtatttgaaatttcatatttcaatatccccatggtttgccatagaagacaaatataaatacatgcatgaaattgtgattttattttcttggttactttttggttacagctcatcactttgcattagtgcatacctccaaacctccaataatctcatatgcatcattataaggagatgaaagggattaagaaataagtttaagtcagtgcatagaatattaaaagttcctttgcatctaatatgaatggaagtgattactattaatataaactcaataataaaataagcaaatgcctgcttttattttctcctaattaacaagtttaatcctttgcacttaatgttagttgtttgccccggagcccggcattggtagacatctcactgctcatgggccattcttgtcaccttgactcccagctcaactttgggatggatgtttcaaaccacctgcctcgatgtgttcaaactttgtgtgagagcatttttgaaggaatgtaattgagtatgaattatgtgacagtagatatgtgaattttgactgaaaagttttgtaaaacttgagaaatgaaccttttggctgggcacggtgactcacatctgtaatcccagcactctaggagctgaggtgggtgaatcacttgaggtcaggagttcgagaccagcttggccaacatggcgaaaccccgtctctactaaaaaacacaaaaattagccgggcatggtggcatgcacctgtaatcccagctactcgcaagtctcaggcaggagaatcgcatgaacccaggaggcagaagttgcagtgagccaagatcgcgtcactgcactccagcctgggtgacagagcgaggcttcgtctcaaaaaagaaaaaaaagaaaaatgaaattttttcttcaattttatagtaaatgaagaaaacatttcatttctccgaagactattttgattgacacccgtagcctatgggggtttcatattccctcttttccgttgttggagatatcatggtttaaatttttaggaagtatctcaatcattcataaaagtgtgagtattctaagttacttcaatgagatacaaaattttggagccctgcttccatgtttcaacttcaaaagtagaagtcagttcgaactccctggtgactgcacttgagaataaactatcagtcaataccacactccttatcttttctttttccttcctacgcccaccccaccccaccccaccaaacaaacaaacaaaacaaaaaggccaggacagcaggttctacacttttgaatgcaattttggacagtgtgccaaatctcagtttcaacatcacaaattaggtttcacaaatggattctgaatatacaaaatgcttttgagtcaccttttttcttcacctttaaattaaaagctctgaaatacaatgaagtgttttcttcagcttttcatgacttttcccattgggtgattcacagataacaggtcctcaatacatttttattaaattcaatttttaaaatatcacttatctactacggcctttctctaataaaaataagtattattcattgtttccatctaaagtaagggtaactgtaatgattaacatgtcgaatgtggatatcccaagagggtaaaatacttacgctttccatcataatcaagttcctcttctgcttaggatgtaaaaatgctatataagaacgttgctccacccaatgagaaaaagcagggtgatctataaaaacgtattattttttgagccatttatatagctgtggccacaaggcaacgaggtgagccaaagtacttcaatctcctccaaggagagactggatacatgaaaggtttacctttggcagggaactggaggaagaagtagtcatcgtaggagcaggaaaaagaaaatagctccaattgtaaggcattcttaaaagtcaggtgtgggctggtatgacatttcagcatccttggaaatgcagaccgaaggagtctgcactcattctggaattcttttccacaaacttctattgggaacttgcaaaaaagtaaggcgtaggacaagagataggaagaagctcccctcagtgacacacaaacatgaagtcaaacccattttccagaccctcctcttctaaaaggcgtaagatttaaggaaagatactaaactgaaggaaagatactaaactctaccacccatgggacccgcctgttcagaggggttggggaaggtagaagccactgagagagggtcaagataccctctttggaagagcagtatgataacctctttggcccaggattctgcaccaataaaaacagaatgatctgttaccactaggggagagacaggcatataaggcttgctgaaaactgaggatggaacaagaagatagaaatccctttaggaccgcagacactattacattaagcacgggatagcagcagcccatcagtggaggtctttgaagactgtagtgttctgaaggttgctacagcaacaacaacccccgcccctccaaaccagctcaatactaacaccactgactcaaaccccatactagcagtatgacagaaaaaaagctatacctatttccaagattaaacatatttacctcattctctatttttcttctatacatgacatctaacattcactaaaaagaaaatgagacttgcaaaaaataaataaaactaagcaaaatacacccattatcaagaagtaaagccatcaacataaccagactaagagataacctatatgcttgaactaacagacaaggactttaaaatatctctgactgataagataaggaatagattcatctagatactaaagaaaacatccaaaactttcacaaacagatgggatgtttcagcacagtgatggaatctgtaaaatgatgcaatggaattgctaacaataagcaataatcaactcaaaatgttaatgtagcaattgcaaaattatttctattataaaaaatgttaaattacaaagagaataacagtaccttaaaatgacacataatttaaaatactacagatgttaatattggaaaaattgtttaccaatgttcacacctgagtactcaatcctttgatggaaggtatgacactataatgatttattataaaaactccttaagtggccgcgcagcctgcgcatgcgcgccggcgaccaagcctaaatagctaccgcctctgcgcgtcgccctccacggttaccccggctttccgcccctccttctcgcggggctcgagggaccatggccgatcctcgcgtgagacagatcaagatcaagaccggtgtggtgaagcggttggtcaaataaaaagtgatgtatgaaaaagaggcaaaacaacaagaagaaaagattgaaaaaatgagagctgaagatggtgaaaattatgacatcaaaaagcaggcagagatcctacaagaatcccggatgatgatcccagattgccagcgcaggttggaagccgcatatttggatcttcaacagatattagaaagtgaaaaagacttggaagaagctgaggaatataaagaagcacgtttagtactggattcagtgaagttagaagcctgaaacttttctcgtatggggtggtttttgcattaaatcctggggtccattttacaatccattatttttgaccactgcggtgtgttcaagtagtatgagaatgtgattgtttttatctggttacatatatatttctttgtctaatttaatatgtcaaataaatgagttcatctaaaaaaaaaatccatacgtgatgtgtggtttatatttgtaactgcctatatgatatatattcttaccccaaccccatcccatcatatagataagaaaatgctacttatgtgctcaggtttacacaactcttagatgtctctgactacaaagtctttgttctttttaatgtacctctatgcctctcatactttaaaattgaaataaattaatctactgctccaaatgatcaattttccatggaaaaaaaagagaacttttgtaattgtaacaacctctgctatatgactaaacactgagccatgaggtgggctgccaggtaaattggaaggcttcatctaaaaagtacaagactgtgaggcatattcccttctcaacagcctaggatgattggatctacccattctgtcacattttcaatatataattcctgttcaaactttctattaatatatcatttcaagtttcattgatagtcctaaaatgcaacacaaaagacgagcagatgatttcagccattccaatttgcagccttttgtagaggggcatcaatagattttactgtacttgcataaagccctagttgttcttttcctattctatcatttctggattggcgaatgggataaaatgttcaggaaagaaaaaacaaatctcaacacaaacgtgaatgtcattgaaagctaaaaaagtaaacaaagttaatgatcacacccgtaagtgctactgatttttcattgaactcagaggagaaagttactggattcccaaaagtaagtgaagggtatatgtttgctaaatgcattcacagcctgttgctctaattatttgaggttttttatgtgttgttgttttagctgttgtttgtgttttttattctttctgcatttttcttctactgtacagttgttattcatgctatgagttatctaaagtttacattaataatcaaattccttgcaccatcccaactctgaaacacacaacttggatggagattaagactcattcaggactcaggcagacatccttagtacccagaaccacaacacagcacacacgaatgcatggttctataattattttatggagcatctatgaatttgctatgcaccggaccctgggaagtcaatgtacagtggtcaacaaaaacaattcaattgtattaatatttagaagccacaaaatgcaaatatattcttttttaatttgaagcttgttattcttctgcacaatctatagctcctattagaatcattaaagtacattcagcagcagtaacaaacgaacagggaaaatgtgaacatgacaaaaggctgccagagtaacacgggtgacaaatgtgggaacattttagaattcccaatttcccactctaataaaataatatgaacaaaaaggctttttttagtagcttcaactgaaactatcacctgatctatttcttaaaatcctcacgaaggtttcactgaaccattagaggtttgggcagtcaaacaaattaaacatgaaccaatctttttagaatgactactgaagtgctcagtatttccagccttccagttaccacagtgaaagaaacaaacaggtacttgtcaggtttataagggaatgatctattttctgcccttttttgcctactctttaaggaaaacacacacacatatgcatgcaagcatacacgcatgcacaagcagaacacaaatttagaagctatagagaaaataaatagaaaacaaagaagttttgacaaaaccaaactgtctttacttttagattataaaaacaatcaactcttttttttattattatactttaggttttagggtacatgtgcacaacgtgcaggtttattacatatgtatacatgtgccatgttggtgtgctgcacccattaactcgtcatttaacattaggtatatctcctaatgctatccctcccccctccccccaccccacaacaggccccggtgtgtgagggaattagaattttgtaattcatttgggtagaggagcaaaaggtatatattaggctcaacttttcagtcggtgatgagagacaaatggcctgccatccctgccctctctcacctaccccagttaatctaaatctgcaaaacgaaaggagcttccactaggccagaggggctgcaggatgggaaaacaatcagaatggaacactttcatgggcgttcctacagaccaatttgcttccagtcagcccatttaatttcatatttatgattgtttaaaagagagagcccaggcgcagtggctcatgcctgtaatcccagtactttgggaagccgaggcaggtggatcacttgaggtcaggagttcaagaccagcctggccaacgtggtgaaaccccgtctctactaaaaatacaaaaattagccgggcgtggtggtgcatgcctgtaatcccagctactagggaggcttaggcaggagaatcacttgaacccgggaggaggaggttgcagtgagctgagatcgcaccactgtactccagcctgggtgacagagcaagagtcagtctcaaaaagaaagcaaggagggaatgggacaattcataaaagcaagccccagcagttctagttaactgtgaactgaaccagtaagatgcacattgatttaacttcggaaataatttatgtgctggtttcttaaatgactgctacatattgccttcttacctgacgatggagtgcagaatatggggacaaaaataagagcaattccaaggaaatgctttatgcccgagtgctaattcagaaccatactgaaaaaggagatgcaagagaatgctcagcgtagattctaggccatccttaaacaatccagagctgaagagccgtattcagagataaatttattctgcgttcaatgtttcttgacctacttctcgtaaggaaaattctgcctgaataccagaaggaattcatttttcactttagcttgaaatttaccttaagataaaacacaatagttgtataaaaatatgccttatttggttatgcatataaagcagacccaagaggatttggggtaaaatatttcataagttgtactatgcatgaatataaaaaatgagaaacaaaaggatagttagtaaaaggctgttcagtcccaaataaaggagtaattgttgatatgctaaataaaaggggggtggggaaagtcctttttttacaagggaatgtgaggaagggaactcacatttgttgaggctgtattttgcatttaatcctcacaactaggctgagaacaaacattaggcattttatttcccatttacagattgtaaacctgaggcaataggattagttgcctgtgataacaattcacatgttgagaatcataatattataggcctccaccacctaacaatgccatcttcagaactacacacacacaggtgcgtacacacacacacacacacacacacaagtatttcgtgagattgtaaccacattcttaagttccatcctttgcaagtaaggtaagttaggcactgtttcctcactgccttagggttgtttataaatacagagctcttgaattacaaaatcaactcttgatttcactgacagaggtcaactgcttttagtgtaagtgaaccatgattctggcataaacagatatagaagaatcctgtttaaaagtttttacctgctctaggtgcctaccaagagaagaagagggggaagttgagagagttacagataagtgagagctagaagccgtgtgggggtgtggggagggtcctgaccctctgacacacacacacacaccttttcaaataagaggaacattataatgtcctcttagggaaccaaagtcctaaagaagagaaggaggttctggagctgctgaaaaatagtgcccaaccagagcaaagggactgggcatgtagattagcctcacaggggtctgagcatctcatcaggtttgtgataagcagctaacatgtgtcggtgcttgagaaggtcatggaagttaggaggagcaagctggcagtctttcaagggtgtggtaatcaggacacagacaccccaaatcctggaggcagaataggcagttcaactaagggcgggatgcaggtactggttcacttcagccaatgcctgcatgcaaagatcttcttccccacagaccacattggatgtcacatctctgtgtgtccttgacctagaatcagaagttggccctgatgccatgaagctaagtaatactcctgtgttattccaatcctagagtggaggctagagtcctaacaactcctgaatgtgaccggtagacctgaaaagtcactgaattttattaagatttcctgagaatggtatattaagaaacctgttaaattaaaagaggaaccaaaatagaaatttaatttagctatagaaaaattaataaaataccatttttagcccacttaaatttgtgtgatactgaaatttttttttcctgctacagatgtataatttagtgcaaaggtgtagggcccaaggcttcactgtgaggaatgtaaatgtgctccccaaaataatttatgattttgactaatgtctgcacaaaatactatagtccataacaggtttcaaatcttataacaactattaatactatcaacatgtagaaataagaaaactgaggcttagagtggttggactctatccattgattgcccaggataacatcaagtgactgactgggggctcaaaattgttctcctgattgtaaatatcaatcctgtttcctatacttgtccatatacttcctgatgcctatttggtgctcaataacttttagattgagtaaaagaatgaacaaaaacatgtatttatttagtgcccggaaggggcatagcaaataattgatatcctttcctatctcacatagcattcagtacagcaaagtaagcaaaattgaggagggaattttaataatgttgaacatctacaaattgctagacactgagatttttatgcactttttaagtttaatcttcgtgttaatccacattacatatgaggaaatggagagagaatatagtttgtcaaggtaatggccatagtccatataatttgagtgcttactatgtgccacctactaaacactttaaacacatgaacatacttcattttcacagaccttgtaagagaggtacttctcttgaccctattgtatggataggaaacaaagcttagcgaggttaagtaactgcccaagttcatatagctactttgcagtagatgagcacaaattgaaactcatgcttctctaactccattattaacccaatagcaggtgctgaaaatcactgatcgtgttgctgacaaaggagagtaaacaatagccacataataatactatctaagggaacattactgatgtacctagattttttaaactttcttttatttatgaaaataaaaatgaatatattcgattgtattttcattcttccctctgtttgtgccactttaaacactggtgcctcccttctctttgacccaaatactcaaaacaggtcacacatttaaatatggcaagccctccagccctgcaaatgatggactataaaatttgtttgtactactggcgatttttttttaaaaaagcttatgcacacctactttcatatttttaggttggacagtaccttagaaataaaaacaaaaattaaaacagatctttatcttttaaaaaatctattttccaaaaggaaacaaatgaattatttttgtcttattattaccatatagcttaaaaatcaattacctgaaatcattatcattcaaatctttaaaacaaggcacttaaatgtttaatcttttttaaaaacttagccaatgcaaaactgctttcctccaaaacgccctcagaattacctgcttctcctgcactcttagtatccccaagttattggcagtgaataaaagtgtaaaggaaatgaatcttgcaattctctgtgaatttcattccaaaaaagaattttaggcattttgatgaagcgatgtagggattagttttaaatagggatctctgatttgtgtattattttcacaatttgtaaacttactttcttccaaaagtgatttgaaataaatattctgaaacactgaagatcaatggaagctaagaattagaaatgcttatacaaatctattaaacctaactgtatatatgcatataatatttttgttaagaaacatagaattctttagaataattcaattttatataattatggatacagacacatagattcacattgtaatgtttattcagattttgtgtttatttgttgattgttcaggcaaacggaaactgcatttggtgtcaacagttgcatttctttatatttatattagctggttagctgtgctggcagaactaaaggaaacctgtccatagagccttacgtagtcgtaactacaacacaatcatgtgtcacaaatttatagcacagcagacctttacactgaaaattgtttagagaaagaaaaattcgactgggagcggtggctcacacttgtaatcccagcactttgggaggccgaggcgggtggatcacctgaggtcaggagttcaagaccagcgtgcccaacatggtgaaatcccgtctctactaaaaatacaagaaaaattagctgggcatggtggcatgcacctgtagtcctagctattcgggaggctgagggcaggagaatcgcttgaacccgggaggtggaggttgcagtgagccgagatcatgctactgcactccagcctggctgacagagcgagactccccatctaaaaaaaaaaaaaaaaaaaaaaaaggagagagagagaaaggaaaacttgaaaaatgaatgagaactggtaaacaactgcagggaaagtaattaccacactcttcatatggcaaactaaagaaagggggcaccgcaagaaaagtattgccagagcttgaagggcagaatgtgtaattaggatgtgatatctggcagtggtgattccaatcattggggattaaaactgtatctcaacttgtgctctttctgttgctttagggccagtgtattcactcaatcttccatgatatctatatggactcactgaacctcagatcttaacttcagttgagcagaactagtcttctctctctcagaccaaggaaggcataacttgtgttccatgaagcctactgtgtcaagtctgccaaatgaaactttaaatatgtaggcattgtctacttagcctgaacactaaaaagagtcctttctacagttcccaaggatttgtttggttgcaatgtttctaaagtcagtacagaaacttccctgaaaatggagctccaaacttatcacgattttcatcctggaatgtatttaggtttgtatccctcgacgtgcaccactcaattgacgtcacatactttttacctgaaatttatttcagtttctcagaagactgtatatttccccagttacagattttactattccttaaatatggtggctgccactttcttaacctacagtattaatggcagaaatgcttagatttataaaaggcaaacatggggaaaagagagacaatattaaattcaagtctctcgaaaggaaaggaaaagataatgaaaaagcaatgtaaaaaatgagagataggtggggcaggtttaagatgccattgaatctctgcatagactgcctttttttttgctctaaatactaaacttgcctaaattaggccacctccctccagagaacaaaaggaaacttggccactatggaatagtaccaaagtgaatttttagaagctattattacccactcataatctatatttttgaaaattaatatatatgtatatttgtaattatcaatattaatacgaagcaatagggtcaacatgaacttggatacttctgttaagttcacttaaatattgaactaatctaatcacttctcattttttctttaaccaaatatgtaaattcaatataattgacttagttctcaaattggttcaataaagtgttcccacagtatttgcaaatatattcgtctttagaatattcctccttaacctttttaagtagaaattaaaatagaaatattaaaacgtgtatttaaaagtggtcttttctcttaacagacatttactttttcttacatgaattggtttagtttttttttccagcactgaaaccattccaaaaaaaactgtagaaaagagtgaatatttattctattggatgtttgttatgtttgcataataactaattagtgaattgaggccaactttgatcaaaatgtttgctctgaatagatatttgctaataaataattttttcatgtgataagtgtgtaataataagttctctatgctgccttgctttgatagaatattcagacaacatttataaatgactaattcaaggaattaaaaggtcttaagtgccccagaatgtagaaatggaataaacatgtggtagtggtgagggtgggctagaaatgattaaactagattttttttaaaaaaagaagcaaaaataccgctggaaaaaatgcacgcagaataaatgtcattatgaaatattctgaacgtgtgtacttgattttccttcatcacggcttcattttgagacgtccaggtcaaccactgtcaaccaatcaatctctagcctctttgagcagagatcaagggcaacagcagagccttaatgatttcaacctctagccttcaagggcacagattacagggactgaaagtaaatcagtccatcacaaggcacttcagcccatagcccatgacaaagcttgattagaatggaaaagtgttaagccatcaaaaacaagacacagctataaggaaagaggaaatataaggctaatgaattttagtgttcataacaagataaaaatgtgtttctcaatacctgtgtagccatttagaaatctaaagagcaagaagaaaattatgatagaacattctgagcaatttcttcctcttttctcaagagcagaattgagatagacttagatgtcaagtctacccattcttctaggccgttctcagacccattttcaaaaaaacaataaatccaaaagccaaaagcaataaacttgtttaaatactgaagttcacatggtgctcatgttttcagaaatccacttacactttacacccataatgtaagtaacgtaccctttaaatatttaactgctcactaatgtttttatttgcatatcatttctttttaaaactagataacacacacttttttagcagatatctttggatcttcactatctcaactgacttttctttttttttttttttttgagactgaatctccctctatcgcccaggctggagtgcagtgtttcaatctcggctcactgcaacctcctcctcctgggtccaagcgattcttctgcctcagcctcctaagtagctgggattagaggcacccaccaccacgcctggctaattgttgtatttttagtagagaaggggtttcatcacgttggctaggctggtctcaaactcctgtcttcaagtgatccactggcctctaactcccgaagtgctgggattacaggagtgagcccctgcgcctggcctcaaccgacttttttagaccacaggtaaatgttagttttacttaatgattgtaattattttgatatactctatatggaaaataaggaaagtattttttcccttttaaaataaggaaaatatataattacgctctatttttttttttttttttttgagacggagaccggctctgttccccaggctggaagttcagtggcacgatctcaactcactgcaacctccgcttcctgggttcaagcaactctcctgcctcagcctcccaagaagttgggactacaggcaagtgccaccacgcccagctaatttttgtatttttagtagagacggggttttaccatgttggccaggccagtctcgaactcctgacctcaggtgatctgcccgcctcggcctcccaaagtgctgggattacaagtgtgagtcaccgcgcccgacctaaatatcctttaaatctagtgtatctatgtgactataatgatgagaagtcaggatgccttccctacagctaaacaaagacttttctgaaatgtatatttggagacccagaatttcaccttatttgaatgcaaaacacttagaggaaataaatcttaatagaaatgatttttacagcatttcgaacacaagaattgtagtttaaaatattgttctttaaagctataagtaaaccaatgtttccaaactgttttttctagagcaaaatttcctagaaccaaaataatcttgaaattttagattaaacaaagcaaaacagattaaatcacctccaagtttctcagaatcttcaacatacaaatggctgttaatatctcaaaaaggaataaaaactgtttttccaaatatatacgagaatgactttttttctcccctagaattagctattgatgccaagctcagtgtttctcatatagtttaaaacacacggaagtaaatttgctgttcccttataaacatatcctgataatatggaaacatttattcaactaactaataacaaaacaggcaacaaattaaaactgattcaaaggggaattcaagggactgaacacacatagtcacagaaagaaaaagaagctagaacaagattgctaagttagaaacaaaacagattaacatcaaaaagtgcaataaaattatatattttgagggtgccagaaagatattacttgtctctctactgaacaaaaatgtgtacatttatgtaaaatttctcagaatctaagccctaatcaatagtaaatactatagggtgactatagtcaataataacttacttgtacatttttaaataactaagagtataactggattgtttgtaacacaaaggataaatgcttaaggtaatagatgccccatttattctgatgtgataactatgcattgtatgtctgtatcaaaatatctcatgtgcttccaaattatatgcacctactatgtacccacaaaaaaattatcttttaagttagtactaagttatacaaagacgcatgtccctaacaaattaaactatctgtcggtagatcttttagacaatactttttagtatgataataaaagaacatctacttgttcttttgccttatttccaagttttagagtttaacaagcttgaatgtgtcataattactcatttaattactcacgtaattacttaagtgtcaggcattgtgctggggactagggagatgatagggaactggataaatgcccatactttttagaagcttactaatgagggataatgacatgtaaacaggaaattgcaaagtggtttgatgtatgttaaaacatagttactgtgggccgggcgcggtggctcatgcctgtaatcccataactttgggaggctgaggcgggcggatcacgaggtcaggagttcgagaccagcctggccaatatggtgaaactccgtctctactaaaaaaatacaaaaattagccgggcatggtggcacgcacctgtagtcccagctactcgggaggctgagacagaagaatcgcttgaactcgggaggcggaggttgcagtgagccgagatcacaccactgcactccagcctgggtgacagagcaagactccatctcaaaaaaagaaaagaaagaaagaaaacaaaaagaaaaaaaaatagttactgtgggatgttgagatgacacacaagagatattcctcctgtaacgtcaattctaggtatgttccaaaaaggagacatcacctaaatgataaactggagttagctgggtaaaaagttgaggtgggagatgacatttccagaagaataacagaagctagaatagtgacttgtatgacatgattagtacgtacaatgtcgttcttgagggatgggtgggttcggtgggtgggaaggggtgaatgtaaagagatagtgcagaggccaattaatggagagattggtagagcatcttatagaattcagatttcacttttggggcaatgagaatttggcataatgagtagcattatctgacttacattttaggaaaactctttttgataacaattgggaaagtggatttgggaagtttgaagaagggaacgtggcaaataaagagacaaggaatcaggaggctattgtaatcactcaggtgaaaaggtggtataaactaaggtaacagccatggaaacagaatgatcacatcagttaattgttcaacttacatacaaaccacaaatccaatcaactaatatttcaaacgtgcaaaatatgtttggcaggggtttattacgaatgtttctataaattatgtctctatacacatatctatacatatatatacatacacacctatatgcctatatatatattccatagttttgtgaaagtgatggtataacaacaaaaaatatattctgtcatatccactgatcacaatagactttgtgcctctggttattttgcaaatcatttaacaattagttttcatttaaaggaagtttataagttaaagtaaacataagacaaatttattcttgaatgttaagccctcagcatcgaggaccatgaaaatactgattaattagtgtgacgaaggaaaacattgaattaagtcaactagttattcagttaaatttattttgaagaaaccgcagaaggttttctagggggaagatgacacaatcgaatatgctttttaaaacattctggctgcatgtggaaaactgaatcacaggggtgggggaaattgaacatctgttttaggggaactgcaacaatcctggcaaaacatgatggctgatgccaaggtaatgttagaacagtgatctcgagggagaatgcaagaatgatacccccaaacctgagaagtttggcacatgatgtctttcaatgagctagagaaggaggaagaattgcttagaaggcagtttttgatctcatatatactgattttgaattaactatgtgacatacatgagcataactgatgggcagggggataggtctctagctcaaaagaatgattttggttggatataaaaatctgagggtcatggttaagagttgttattgctatggattttgatgagatcaagaaaaatatgttgattgagcattaagattgaagctcaacgttaaaagagatttacgataggagagcaaccctccaagaaaatgataaagttgccctgagacaggaaaactagaatagtggaatatcttagaagccagggaagaagagtttttccaataggaaggaccgatcaacaatcaatactacagagtggtaagatgaggcctgatgtgacttgggccgtgacaaaatcaatttcagttgaaggatgtggaagcagccggattattggtgtttgaggtagctacgtgagtaaggaagtagatacaatgagcatagaaattgttaaagaagtttagcttcaggagtggaaaataacaagtcggtaggagattaaaaactaatagcagaatgtcctatttgttactacaggcaacactgtattgcaagttaaaataaattagttaaacctgacacaaatgcctgaacgcaagaaaaaaaattaaagggtttcttcaaccagacatttgtattttaagcattttattttggcaatcaattggggaaatgagatattttctcctcaaaggtaatgctgtagcagttataattgtattccaggacttgcgggctactattacaaatactcatggaaattaatgaatttttatccccctggctctggaggagtggctgaaagcaccgtgttttatagtctgacaaatttgggttctattcccagtatctctggataccagctatatgaccttgaacaaaatactgagcctctttcaaagcctcagttttctcatttgtaaacaaagcagtaacaatagctcttttatagaatcatggagaagaataaataaagtaatgaatgtattgtctactacactgtctctcaacctagagactatatcaaaatcccctgaagaacttcttataatacctctcccagaattcattatctagtaggtctccgcacagcccgagaatttacatttcttacaaatttccaggtgatattgcgggtctgaaacatactttgagaaccacagctttagcacatagacagtcacataacaaaaaccaatgaatgtaaatattagcatttctttgatggagacagccccaggctgcctacagcaagatgttcccttaggttcctgaaaatagaaagtcccgcatggtcctcatcaaagtccgctggattccttcaatacctcttcctcttttctcacatgggcattaacatccccactcctctaccttctaactcaattatctgacccctgcgctcttttttttttctttttcttttcttttttcttttcttttcgagacggagttttgctctctttgcccaggctggagtgtagtggcacgatctcggctcactgcaaccactgtctccagggttcaagcgattctcctgcctcagcctcccaagtagctgggactacaggcatgcgccaccatgcccggctaattttttgtatttttagtagagacggggttttaccatgtttgccaggctggtctctaactcctgacctcagatgatccgtctgcctcagcctcccaaagtgctgggattacaggtgtgagccaccgcgccccggcccccctgcgctttttataaattcattcattcattcgttcgttcattcattcaataaactctgctacagtattcagagactcttttctgccatatttgctttgatctagttaacacttaatgagtttatataccataatatcccttttacagtatcctgtaacgaatctctttatcatttctagcttatatcatggagtctgtgacagacaacaagattgcctctgaaccatgccctctactgatgtgggtattattatactgatgagatttcttctttctcgttctctgttatgaaaaagcaagctcatggcccacggggctcataaaaaatgtactaaaggctgagagcaatggcaactaatgatatacgtgtaagtacatattgatcaaattagagatgattttttttttcacagctcagtgatgtgtctaacaatagtattctgggaaattccatatatacataatataagccatggctttattcagatagaacaaatgccagataatattgttaggagcttctacaatagcaaaattcaaaatcacattatcattttaaaacacataaaatggctcactttttttttcttcagtgcctgtccatcttgtttagaaaagacttgattaaagccacatccactgataggcaatggaagttagattagatacttgtgtatccgatactgtttaaaagactggttctgttttataatttgaattaaatggtaactaatctttttttttgtaggagcttgggctaggcaaagtaaggaataaagaaataaagttacattttctatgactagaggtattttagaagaagttgaatgcgtacttaataaaatgtgtgttctatggagattctacgcatgcatagaaaactaggtgaaataaaaattctgcacatttctgtaagcaagtatcaaggaaaaagagttctgaacaattgcagcaccctgtaagtctccttcatgctctttcccaattcacactatattcccaccagcctctcaggaagaaactgctctgctgacctgaatcattatagataactttggccagttctcaaacttcatatagatggaatcacacagtaaatgttcatcttctagtcaacattgtgtttatgaagttcgttcatattcttccaagtagcaggtttttattactatataatattccacggatatacccaatttttgttttttgtttgttttttgtttttgtttttgagacaaagtctcgctctgtcacccaggctgaagtgcagtggcatgatctcagctcactacaacctctgcctcctgggttcaagcgattctcctgccttagcctcctgagtagctgggattacaggcgcctgccaccacacacggctaattttttgtatttttagtagagacagggtttcactatgttgaccaggctggtctctgactcctgatctcaagtgatccgccctcctgggcctcccaaagtgctaggattacaggcgtgagccacctcgcccagtctataccgcatttttaattctaattctgagggacacaagttatatcaggttctgctattatgcaaaatgttgctattaactaccttgtgcatgctattttggtggacttaatttctccccttttttgagacagggtctgactctgtcccaggcaggagtgtagtggtgcaatcacggctccctgcagcctcaacttcctgggctcaagccattctctcatctcagcctctggagtagctgggactacaggtgcatgccaccatgtcaggctaattttgattattattattttattttttttttttgtagagatgaggtcaaactatgttgcccaggatagtctaaaactcctggcttcaagtgaccctcccactttggcctcccaaagtgctgggattacaggcatgatccactacacctggcctactaatttcttttgaacacatacatatgagaggaattgctggctcataaggaaggcataaatttagatttagtagatattggcaaatattaatttacacttaaaccagcaatatttgagagctccagctgaggcaccaattctccccaatacttgatattgtcttattatattttaaccattcggatgcatatataggggtattcaaaattctttgattactaatgaagttaggcacctattcaaatgttttttaccatctttgtcctcttttatgaagtgcctgttcaaatattttgccaacttttaaaaaatgggttgtctttttattgatatgtatgagtttattatatattatggatacaagttttctaatcagatatacgtcttgtgaatatttttctcccagtccatgacttttcttttcactgttattagtgtattataatagatagaattcttagttttaatgaagctcaatttatcagtgtttgactttgtacttagtgcttgttcggtcctaattatgaaatctttgcttagcctgtatctcactcgtagattattttacttatgactggagattgcccaccagatgtaaccacttacacactaatggtcacagccatattctccttgactatgtttacttaatcaccattggcagagactatgtctcgtctaatattcttttatcccttattcagagactctcatattattgtgactgtaaattttcttagctaaaataatttccctctatctctctctgtctcactttctttctctctctctctctctctctccaactcccaaagatatataagtcggatttattgggcacagctaccaggaaaaggggttcaagaagggttacagagcaaatgaataatcttttgctagggctgaggagtccaactcatggcctcgatataatttttgagaatggaagctgggaatagaagatgtcagggaaccctggggttgttaatagtattgaaacaacctaccttgcagtacttttgagagagatataaaaccatcaccctgttctgaagctcgagccctagcttattattttccctttatcaattcacaaataaaagcaatgaatttcctacaaatacttcttcttggttttgaaggtatgttatagaatagaaaaagtcttacaaaggtgtattttcacatagtggttggtgatggtggacagaaatttttaaaaatcatatgtacccttcatttcatatttttataacaaaatgacaatttaatcaatgtattaaattttcaaaagaaaatgcaaatatctgttctacatagattgaagaccaagaatttctgccagtgatacccagccaagattagttttcagttagtctttttataccatctttcaaaacaaatggtaatgtgcgatccttatactgttaaagaaaaaattattcaatgtcacttgctgaatcacggtaaggcaggctttattcaagaccatctcaataggtatagggaccgtgaaaatagggtcttgcagtaggggagagagattgagctcaatttgaatacagcacaggcaaatgggaattttataaccaaggaacagggtaggggtcagtggatggaaaattattaagaggaagcatcatgggtaagggagactcctgctgaaaatagtccagtcatcccctggaggatggtggatgatgaggaacatgatcagatatccaggataatcaaataccaaggatgagtgttttctggctaaactgatctggcctgctaaaactaaattttaggagaatgtgcacagactgggctatgagaaggttgggaagcctgaataaattttggccgagcaaataatctttgtcagtactaacatagttaataaacagagagtaccccagtaattcatttatgaaaatgtgtttcaaaaaattccagtctcgaccaggcgtggtggctcacgcctgtaatcgctgcactttaggaggcagaggcaggtggatcacctgaggtctagagttcgagaccagcctgaccaacatagtgaaacccctttctctactaaaaatacaaaaaaaattagccgggcgtggtggcatgcacttgtaatcccagctaaccgggaggctgaagcaggagaatcgcttgaacctgggaggcagaggttgcagtgagccaagatcatgccactgcattccagcctgggcaataagagtgaaacttcatttcaaaaaaaaaaaaaaaaaaatccaatctctttgaaagttatgtatcacttgacaaaaacatttcctttgtgacgtaggttcagaaacattgggttaaactaagttaaacaatttttttaactacaaaacatttcagggttgagttgtgactcgctaaagaaggaaatgaaattatcacattttaacaatttgtttttcattcaacatcttacgggatcaatgttctttacaatttccatttggaaatgctgttctagactcatccgttatataaattatacatttaagaggatgttggttctaaatactttaacttgctatcaaggcagaaatttaaaagcaaatttgctcttgttacgttattctcttttatatccaagagaaaaagaatgttaagttgaaagttattttgctcagggacacttacaaagatatatacacattcagtagacacttgcatgacattacatttgaaattggatatatcttttagctttttatacacagatcatagtatgcagattttaagtggtggaaaatgaatcttttaacattcaaagtgatgagctttggagaaggctgttttaatctgttatactgcaggtgtaactcctggtacacttgtaggttagtagtgatattgtaggcatattcgatggatcaatatatatggagtacttgatattcagatattcagttctccccgatgccttaatctgggtgttgtttttgcagtggttaggaggaaggagaggaggtgccaagattcagacactgcagaagaggattatataagcagaaataattccatgatgcggttttgtacctgtttactacaaatcaaaggtggctgacacaactttgtccccaggaattctataatggttagacgatagctgtaaatacgctcctgtgttccttccagaggtgtgtgggaaaccctgagaatggggtgtgcatttgcccctagttaagggtcaacgaaatctaaggcagaattcagctacaggtttagagctatagtctctttagagttccaggtgtcccttttacttaaaactctttttttccctgacattttaaatataagtttccctattcactttgcaaagcttagttaatactgatatgtaacaaaaattattcgctacacttgagcatgtctcttctccataaagatccagctttagatagcaactcttctcatagatctgtaagtattgtgagaagataattaaaagtttgattattgtccatataaatagacggtaagaaaatacacattttcagtattgaataaagactttccttcttctcagcagaagttgattgtattccagaaaaggaaagaatccttcctttcataagggcaaattaaaatgcaggaactctgaatttgggagtctgtttttcaagatgaataatcatctttggcaataggattcaaatggcacaacagaaggaattgaattgatattgaataatctgaattcttgatccaacctctatttttgaatatgtacatttaagatcactttgtgcatttaactctcattatgcataattgcataactggacaacaatatttgtttcttcctggaattcaaggagtttattctacaatttttgtttttatttatttatctatttatttttgaaagatggagtctcgttctgttgcccaggctggagtgcagtggtgtgatcttggctcactgcaacctccacctcccgagttcaagcaattctcctgcctcagcctcccgagtagctgggatcacaggcgtgcgccactacgcctggctggtttttgtatttttagtagagatggggtttcaccacgttggccaggctggtcttgaactcctggcctccggtgatccacccgcctcggcctcccaaagtgctgggataacaggcgtgcgccattgagcctggctattctacaatttttagaaaggtagcaacttctttccccacatgacattaagttttttataatactaaatatgaagctttaatgcaccaaacatacttgcaatcatcaataaacatatgacatatctctactaacaagcagattggaaattatggcatcaattcaccatctgtgccacacagactctagttttgaaactcttatttgaaacagaaagttatatatgagcataagaggacactgcacatggagttcttctaactttatgtgtaaatttctacttaatagaatatatactgttataagctgcttcacttattgttaaacctatatacatatacattaataaaaagtcattaatattgacctacaaataatttgagttttaaaaaattattattactgtacttcatttttggaacaggaatcaaattataataaaactagtagcacagaaacagacaagattactttggttaccagagactctgccaaattttcaatgataatttacatatgaaaaaaatagaagaaaaagtagaaaatgttaccatggcagtaaaatatgcatgtatttgaggatgatattcaacaggacttacctgcaacaaatataaaaagggaagtggaaaaattcactaaatcccttaaaatgttaagtactgagggtggaaagtaagatagataataattataatttttcctagaatgagggtaaggctcgagttatgaaaacactaacaccgtcagagtaagtcttaagggagaaccacttctggaattccctggttttgctccccggctgatgtacagaacatatgtctctagaagaataatcaaaggcattacaaagaaccctctcactaattgctgatagttacagtacagtcctagacacccatagaggcagttctttgcccctactacacatcagaaccacctagagagccataaaatattacctaagcccataccccaccccagaccaactgaatcactatctctatgccggggcttgggcatatggttgaaaattgcagtcctagatgacctgctacaatacacacacacacaaacacattttcaacttcatgtactctcatactttccacttcacgcactagcacttgttccctgtaccttcctaagtccacttagaaaatcagattttacatttttaattttttcgtgtgtgcattttaatgaaagagtatcactaagataaaatgtgacagtaggcaaccaatttctttcttcacagagcattgaaaatagacataattgattgccttagattcatgcccatatatacatatatatgcacatatatacttcaaactcattttgatagggcacagtagtgatttcctggtgtaataacaatccgttcatttttcatgtaacattgtctatatgattttattatactttttatacatagaatgaaatatttgttaataaatgaagaactaagggcactcactctatagcaaaaatgccacctctactagtaagaaaaagaaataaacattttctattattgcggcaactttctaaaaggaaaaaaaaacacaggaagactatcacataatgaaatcctttaattgttacttctttctctatctcactctcttttgtttcatccaagaaaactatttaactattatatagtgatatgtaattagagtctttcaattaaaattgttaagctacagattgttgacaccaccgaatatacttgattaaaataagtatagatgtaaacaaatgtaaacagaattgcacttaaatgatattcattatttagttcatttatttaaaatgcattgatggccagacgcggtggctcatgcctgtaatcccaacactttgggaggctgaggtgggtggatcacctgaagtcaggagttcaagaccagtctggccaacatggcaaaaccccatctctactaaaaacacaaaaattagccgggcatggtggcaagtgcctgtagtcccagctacttgggagactgaggtgggagaattgcttgaacttcagaggcggaggttgcagtgagccaagatcgcgccactgcacttcagcctcggggtcagagagagacttcatctcagaaaaaaataataataaaataaaataaaataaaatgtatggaatggccaaccaccattctacgaagtaagaactgaaagtctaataagcaaaggtctctacttctcagaagctctgttggatgatacaggtttgtgtacaaatattacattaacatggaaaaagtgctaacatgcagtagaggaggcataaacttgctcgattaggtttggtggttggaggttttacaaaagagatgatgaggcaaattggtgtttacctacacttgacagcccccacccatagttagtataaaatgtaattataattttgtgtatacagtacttgaaaaattattacagccaatcacaatagtggatataaaaattccaagtctatttacaaggaaaacattctggccaaatatgaccataaatatttgtgcttacaatacctagaaatttcaaatgtttgatatgttaaatatttttatttgtagagttcttcactttcaaatatagattacttttaatgagatagaaacaattatcagtttgattcattaagggacaatatcactttacagaaatttacatgtatttattaacatgtgaagcactttagtagataaaaaggacatttttgtatcacttaaaacattaggatgaaattatgaaatgtacatgctgcctactggcaccaaagattataagccggtctcacaattggcttttcattatataaagaacacccattatatgcttggaattcctatgccagcaggcatacagcaaatgctggaagcccattgttcataactttacttcttgccaagcatttcagttatattttctttggttatataaagggccagagctattttaagtgaaagaggtagccatcctcatctcactatatgacagatgtcatattacaatgccctacataatagtatgcaagggcaatgctacctccttcgacctggtgtaaaattccttagaattacaactgtgtgtttagacaataaaaccgaaggatttgcctcaaatatcaaaactaagtgcaaatgggcaatgctatatagatgagcaggaaacatttctcactctcctctaagtgaatgctaatatgatttcatgaattgacacaactaaattttgctttataagaacatacatagccaaaggatttaaaaaaaaaaaaaaccaccttaaaacaagttacagagggttaaacggaagcaaaagtaggtagctaagtattaggaagggtggaataatgtctaggaaacgagagtaataaggccaggtgcagtggctcatgcctataatcctagcactttgggaggccgaggcgggcagatcacttgaggtcaggagttcaaaaccaacctggccaatgtgatgaaaccgcgtctctactaaaataaaaattagccaggcctggtggtgcgcgcctgtaatcccagctactcaggagggtgaggcatgagaatcgcttgaacctgggaggcagaggttgcagtgagacgagatcacaccactgcactccagcctggacaaaacagtgagactctgtcaaaaaaaaaaaaaaaaaggaaggaaggaaggaaaaagaaaagaaaaaaaggaaacaaaagtaatagactaatcttaggaagctggctggagtagaatggcatagagcccccaacggtaccagcaatgtggggtaggtaggactcagctcctagatcttcttatggtcctcaggacataagaagcacactaaaaggcctatagaggatagatgatgcccatttaaacctttaattctgcctaaagttctgccaggtttatgtacgggcatagtgcacataaagcatgcataagaatgcatattttttgccttgcctttagtttttccaggttttcatgatattaacaccaacgattatgtcagagttatgctttgttttttctcaatgggagaaatccaagcataggccccctaaagaatgaaatgtaaaacaatgactcctgcctgatacaaccagaaggaagattgacaatacaacatgaaaagtcacggagtaaattattttcatacaagtggagaaattattttcagggaattcgtagaccgacagctattcacaggccatcaaacacccataaggacctttgtcatccttcaatcacttcagtagagagagaacatgtatgaaagagacagaaaacacagttaaataagcaattcctgttcagtaagtgtctgcagggagtttttcagagtgtgtacggataacacgtatacctactcgatcctacaagtgcgtggttctgaacagaagcaaatttgaagtattaataacaatgaagatggaaatagggttgttgaaaattctgtatttaatgagtgaactcagcgactgcagacacaaagagtgtggattctccgaatgattataaaagccttaatagaaataaatgattactaattggaatgggacatgaaagaagataaccttgttacaaagattccaggcaaagaaagaagagatggttccaattacaataatcaaagaggtgattttcttagaatatggctaaggaaacacattttcattcatttgtttcattcatttttttagtgcagtgtttgggaactaacctcagtactagtgaacatatgatgttaattctttagcgaggccaggagcggtggctcacgcctgtaatcccagcactttgggaggccaaggcgggtggatcacctgagatcaggagttccagactagcctggccaacatggtgaaatcccatctctactaaaaatacaaaaaaaaattatccgggtgtggtgacgggcagctgtaatcccagctacttgggaagctgaggcaagagaatcgcttgaacccgagaggtggaggttgcagtgagccgagatcacaccactgcactccagcctgggcgacagagccagactctgtctcaaaaataagtaagtaaataaataaataataaaaataaaaattctttagtgagatgaactgttaatggttgattccataatactgattctcattataaattactgtaacttttagttgtcttaaatattaaacaaaataacaacaatagtgccaacaagtgctgctagtgctgaaaatttcttcagattgttagaggaacagtatttcagtacatatattttgttacaatttcgagaaagaattcaaaacccagaatgggaataacaaagaccttttagagttgtgtttctcaaagaaagaccccaggaatacatgacttgtaaagacctaccagaagaatatcatttagaatggggctttagaatctgcatttttaataagcattctaggggattctgctgtattctagagtttgggaaggactgcctagtagattgtaaggccaaggtagtgattaattgatctaggctagagtaaagctgtggctgaaatatttttctaagttctcccagtgagtctaacagccaggagaaagaacacctgtgcattggcagtgacagcggaggaggtattgtactttgccaaggaagtatgcacagaatcatttttatataggtaataactgtatatctaacaaaactctatttcatttcactcttaaattcagaaaaaaaatacatgtaattcaaaataaacgttatcactggatatggtagcaaaacaacagtgcgtagatatgtgcttatgtttccgtgtgagttctatctatgtgtgtgcttatatatgtgtacacacacatatacacaacacatacagtgagagaaagagaggcagtttataatcttccaacatttttggcttatgtcaacctgtaggttaaaaatctgactttgtgatgccaaagaggaaaggtataggaaggagcagagaaaataactcaaatatggtttacttaggtatgggaggtgaaagattatttgtggcatcattacagctttgtgaaacaattggcaaggttgtgcaaagtaccatcttgatcagtgaagctttttcccttaaggatggattacaagtgtgtaattcaaccttgacttgtagacctccatttcctctctagttatgtgaatgtgcaccatacaatacaaagttctatacctattactttaaaccagtaacgttttattgtacttaataatagtcttaggctatctaggtaatctctgtttataggtgtttacaaagtaatattattttatgtaaactaataaaaacgttggtgctaattgctttacacattgcttggaaaagcaagccatttttgcagttgagtagttgctcagcactattggccaatctatttctatagcttcttgtttttcatctccttcaacaagttcatctgccaatattttgctccccgtgttgctctaatctcaatttctatcttaaaaaaatacaatggtaagggggtactttgcaagttaggcctaagaaggagactgatttcccaaggatgttcacgttgatttattgccttttaaaatactagttgcacaatgaaatgacaaattctgccaatttacatactattcctagtgtcattctttcaatttttcaaccagaattcatatacacagaaaacatgcttttcttgtttcctgagttccttcaagcaaaacataattctataatgagcaattatagcctaacacctgctgctatgaagaggaccttgtcaacatctatctaaattgaagaacaacagcattccttgattttgggaaaatgagcaataaacgaagtccatttcttagcagaaaaactcataggcaatgtattccaaggtagctcacagaataatcaggatttaatagaattagattttttaccatcatttgagagaaagttttgctctgggctaagtattatggttaaggaatccaagaaaaacactaaaattcctggatcccttacaggcaatatttacttaaaataaaaccatccataaaagtccttctctactatagtatctcttcctgtttttcttatgaaacaagaactctgctcaagctgaaaggtaaacaaatcggatagaagcatcatttgagctcaagccatatcaacaatcttgtggatttacattgccaggaaatcttttttcaaaattatgccgggataattacatcaacaaaaatggaggcagaaatcttggtataatatcaaaaagatgggggaagaataggttgctggaaaaagcctgctagcagattgcctagaaagaaaaatgaagccattctaatatgttaaaatctcatctaaacattgaaataaatgattattcacttacagagtaaacagatatgtttaagtgtatttttttacgtagtcacatgtatatatgatgtttctgtgtgcctatgtacacgcacacatacatacacacacttgaacgtcaacttgtacgtattaatagtgcaataaaaaatgttgtcagggatgacttcccctctggcattcccagcactatgactgacagctcttactgcatcaatagaagaattgtatttaaacaaaagttatggtacaattcctaggttgatgcttaatagacagtaaatactacaggaactaccaataagcttccttattaaataaatgtatttattcatttgatcttatgtaaagaacacaaaaggtaaaagaaaaaaattaaaaaagagtattttatttttgtataattaaaaaatctagttccttcttcctggatttgaggtatctatatctgtatctatccatctctctctctctctctctctctctctctctctctatatatatatatatatatatatatatatatatatatgttcatatctatatcaatattgataatgtttctttacttcttaaataaagaattacctaagcatcttttttcaagcgggagaatgaaaacacaattattctaagatggcgaatattgacaagggaatgaaatggtgaaagcaaatctatctagaaaaaagggcccccttagcctgaatgaatagaccagtgaatgaggaaacaaaatgattaaatcaagtcttttgaaagcacagcattattgtgagacatattgtaaagatctgtgcagctattctgcccttcctacatactcattgctctctattatacaaagaaggaacacagagaaaagaacattatacttgaagttagaatacctgggtttgagtgtgactttatcacttactaattatgtgatcttgaacaagttactcaacctctttgtgctcagtttccttttctaaaaaatggacatacaggccggacttggtggctcacacctgtaatcccagcactttgggaggccgaggtggcagatgacttgaggccaggagttcaaaacaagcctggccaacatggtgaaaccccgtttccactaaaaatacaaaaattagccaagtgtggtggcacatgcctgtagtcccagctatctgggaggcagtggttgcagtgagctgagatcacgccacttcactccagcctgggcaacagagtgagactctgtcctgattaaaaaaaaaaaaaaaaaaaaggatatacaaatatccagggctaattggagattcagatttgataatgcataggaaagatcctagtacactataagacaccttacatttataaagtagtataattgtcatccacataccattattattacatcatagtgaaaaaatacaacttacaagagttcagctgagcttaaagaatatattcatttgaagcccaatcattgttgtgtgagcttcttcatattatcttatttcaattattatgcttttatcttagactctaattatatatccagttttacttacgccattaaatgaattttaaaaggagtcacattaaataaaggccctttaaattttttatgagataaagagttgccatagacacactcttttgcatcttacccggtacagtcaaactcaattaactattcagactggcaaagcatcttttacatttttcgtaaagattctaagtgaaaagattgtactatttttcaattaagttatatatctttcaaaaatagctggtagattaaagcaaaggcactgtcacaatcacagattctatttagtgccatttagaggacaaaaatgaagccagctagacttgaaaatgtgttcatagtgatttttcaatgtatcaaaatctactaaatggaacattgaatggcaagtccaaaggcatgtgatggttaagaaatctggtcacaggcccagcgcggtggctcacgcctgtaatcccagcactttgggaggccaaggcaggcggatcacctgaggtcaggagtttaagactagcctggtcagcatagtgaaaccccttctctactaaaaatacaaaaattagccaggtgtggtcgcaggcacctgtaatcctagctactcgggaggctgaggtaggagaatcatttgaacctgggagatggaggttgcagtgagccacgatcgcaccactgcactccagcctgggcgataagagtgaaactctgtttcaaaaaccaaaaacaaacaacgacaaaaaaatctgggcacagataattacacaaggatttcacataacctctctgttattcatttagagatgtctaaaagtaattcctgagaaatttggaatttttattgaacatgtcagaatcttctctaaataacttctgaatcacctgtaaatgcaccattgatttggataatggtggaatctagctgtggaataagttaaaaggtcataaggcctccaagggtgaaatttcagtgaggtaaccagccaggctacggagcagctcggtgagcatttcatcagtttggagtagaatatggggagatgataccttttctcaactcaggtaaaaagaatttgaccaagttctcataccagcttttatgttacacagctgtttattaccatcaatgtttttgaaaactgggcagcataatttccatcatgctatgtccctggttctacttattatttggacctcctgatttactgactaaaactactatttaattatctgtatacaaattcaccggccattttcctttgaggtatccctatttggccagaaaatttagagcaaaagatgttcaattcagaaatttctttttaatgttatttatcagttttaactgatatacataatctttcactttactgtcagagatttataacaaaattatccagtgatatctactgaataaaaaagtaatgtttatcctcagtataccaattgttcagttttggtgcaaggtggtttaatatgtcacagctctaggtaagaatatagtaagaaaccctgagagggacatgtttaattgtaaaactgtgaagcacataaatacatacttactattatcaataataatagttaccatttaaatattgcctgctatatatcacaaagcactaagaggcttaaaatacatttttctctgtcctgtacaattctatttaaaaataggcaaaatttctccactttgtatgtaaggagaatgagtcacaaaaatgttaagcaacttgatcaggcccaactgccaataagtttgaagacaggattcaaacctcagtttgcctctccaaatctcaggaactataccaagccatgagttacatattaaacagctaaggcaggtgggcgtggtggctcatgcctgtaatcccagcactttgggaggctgaggtgggtgggtcacctgaggtcaggagttcgagaccagcctggccaatgtggtgaaaccccgtctctactaaaaacacaaaaaattagccgggcttggtggcgggtgcccgtaatcctagctactcgagaggctgaggcaggagaatcacttgaacctggcaggcggaggttgcagtgagccgagatcgcatcaccgcactccatcctggacaacgagagcaaaactctgtctcaaataaataaataaataaataaataaataaataaataaataaacagctaaggctaacagtcaatattaaaaattataaacactaaagtgtttctctaacttattattttgcatttaacaaaataccattttcccataaagtctattgttaaagcaaactaaatacggcctgagaaggactccgtacttctatatttgagtccctgtggatgaactacaacctatctcaataggtagacaagattgaaaaactaacttaggagtatgggcctgtgacaatcactcagtcttggccaatcccagccgccattcttcagccagttatacactgctgattgttcaaactgtgttcaaataaggcaaacagcgagctgtaaccaatccagctgtttctgcatctcacttccgatttctacatgtcactttacttttttttgtctataaatttattctgaccacaaggcacccctggagtctctctgaatctgctgtaattctgagggctgcctgattcgcaaatcgttcattgctcaattaaactcctttaactttaatttggctcaagtttttcttttaacactatattttttttttttgtcttttagcatcatttttaaaaatagcatttaactcctttgattcagtggttgctatggtttcactatttatcccctccaaaatttaacccccagtgtggcagtattgagaggggaggcctttaagaggcacttggatcatgaaagttctgccctaatggattaatgagttaatggattaatgcattatcatgggaatggcactggtggcttgataagaagagagacctgagctagcaagttagcatacacagccctcctgccatgtgatgccccaggccattgggaccctgtagagagttcccaccagcaagaaggccctcaccagatgtgtccttttgacctgggacttcttgaaatggtctttgcaaaaattataacggtgagaaaatgatggaagtgaaagggatctaatctagccaactcctctcttgcctttagccttcaagctgctcttaattattcctgggcttatgccaagctaactttgggagacatttatagtttaaatgacaatagcccttccccaaaactcaaccgcgtttgtagagctaatgagagaccaccaggctaggaggataggggaaactaaattctgctgcggtgtagacatacaggattgccagccattattccagaggtcacaagacacgcgacttccccaactactcttgcagacaacatcactattgtagaacttaagattggccttttgagatatctgttcagatatatttcatgtctgatgactgatggctccacctgcacctgccaactgctcctgtggccccgcccagaagagactcagtgcacaggaggacccttgcccacagtcctatgattgcaatccctaccagtcagcagcaagcacctattgcgtagctttccacatgcctttccccaaaccgatcttgaaaaccctagcctcagacttcttgaggagactgatttgagtaatagtaaaactctgatcttctgcttagctggtggctgtacatgtataaaactctccattgcaattcccttgtcttgataaatcagctctacctgggcagcaggaaagaagaacctattgtgcagatacattctgagcctccataactgtaagaaataagttcctttttgaaataagtaacctagtttcaggtattctgttttatagcaacagcaaatgaattaataccgagcaaatgaattaataccgtattgggatatcttagatgttttggcattgaagctttgtcttacgaaaatgcattcaggtattgaaaccaccattgcaaaattataactgaaatagtgaaagagatctgatgtaaccaactccctcttgcatctaagccccaggctgtccttgctcattcctgggggtaagctgaaataactttgggaggaacttagtttatagcttatggtttaaaacaaaggcaatgacaacccttccccaaaaccaacctccttcttgcctggggactagactgcctttgtaggactaacaaaatagccaaaagattagaaattacggtttagtagtcatgcagctagagactacaagatactgcttctccccaaattgctcctgggcataaagtcaccattgtaaagcctaagatcagtgcttgagacgttttgcagaccctgcactcgatggatcaactggtaccacacagatcaataaactggctcatctcatcctatgaccccccactcaggaactgactcagggcaagacagctttgactccctatgatttcatctctgatccaaccaatcattacttctgaccactggctgctccccacccaccaaattgtccttaaaaaccctggtccccaaatgctcagggagactgatttgagtaataataaaactccagtctcccatacagcctgctctgcatgaattactctttctctattgcaatttccctgtcttgataaatcaactctgtctagagagtgggcaaggtgaacctgatggcaattgcagtatgtatgtatacccaacatcttgtatgtaattttaagggatgcaaggatcccaaaataaactagaactttagggtgatcgagtgtctggtgtgcctgggggctaagcaggtttgtgggatatgggactttaaattttaaaactgagaaattcctgaaaaacaaaaacaaacaaaaataaaacaagaaaagttggttaccctaaaatgtaacgtttatatagcactttaataaatactatttactagaagctaaggcttttggttatgtatattataaattaggccatagggcaaagcaagaaaatgaaagctttactaggtcaaaactgtgaccgcccaagaggttcaactcgcctgctgcctggacagagccgattcatcaagacaggggaattgcaatagagaaagagtaactccctcagagccagctgtgcgggagaccgaagttttattattactcaaatcagtctccccaagcattcggggagcagagtttttaaggataacttggtgggtggggggaagccagtgagccaggagtgctgactggtcagagatgaaatcacagggagtcggagctgtcttcttgcgctgagtcagttcctgggtggaggccacaagatcagatgagccagtttattgatctgggtggtgccagctgatccatcaagtgcagggtctgcaaaatatctcaagcactgatcttaggagcagtttggtgggggtcagaatcttgttgcctccagctgcatgactcctaaaccataatttctaacactgtggctgatgttagtcctacaaacgcaagtcccaggcaagaaggaattttgctctgggaaagggctgttaccatctttaaactgtaaactaagtttctcccaaagttagttcagcctatgcccaggaatgaacgaagacagcttggaggttagaagcaagatggagtcagttaagttagattgttttcactgtctcagacctaattttgcaaaggtggtttcaatcccttcctttgggttttctaacactttaaccctaaggtataggctataaagatgggaaaaggccgtcgatcgctctggcttcttcctgctgatgggggaagtagcgggaatgggaacgaactccaaggtgagaagagtggaactgctttgcaactgtttgagtggattcatgcaggcctaattgggcttccaaggcttgcgtggcagaaacattattactctcatctatagttttactacagtgtttatgtgaatagcctactataaggtataatgagtcctaggatgagaagtacaattcccaattttaaaagcaaacatttgaaatcattagtttgggaacttctaacccacaaacaatttagaatttagtctaaactgaagaattaacctcaagaatagctaatagtttactatagattttcttttgaagcataatatttctctgttcagtccccatttttattaaaaacaaatcatgatagaaatgatttgcttataaaatgcattttagtcttactgtacttggcctgattatttgcatgaagtgcagcaagaataattatttttcacttaggctttttaaattggctttgatggaactctgttccatgaagaatctcagataagactttttgaaagccgagcccagccatgggtttgtaccctcaaatacctatgagttgaccaaagtcctctcctcttgaggtcccaagataacttggggttcctgggcctgttagaaagtgacattctttacttaccacaggtcaggaaccttgtacagggactctgtgtggacaaggtatgaggccagattccccaacgggctttaaatggctctataagtcaactttgattctttaaaggaagcatgccattccagtcaaagccttggtaaaatgaccaatttctccaatggtgtcctgttacaaaagaaaacagattcttattgcacgtatgcaattaactatactgtcataaattgagaatactcacaaatggtttccaaattctagagaaatcaggtagagagaaacaaatttgctccaaaatttgtcactgagtgtattttactcactcggtaaaagtggcaaatagctctaaagaaataagttatgttgactctgaaaacaaaaggattagcaatgtttaacacatcagtttgccacatttagatgttttttccctctattccaagagcataatttttaaagttatctaagacctgcactcagagtattatatccgattataaactgccttttgaaaaggaccaaagcaagataaaatgtctgtggatgacaaaagtctacagccattattaaagctacaattgactaggaattttggttacttccgtggcacacaacaattttacataacaattataattattaatagtgaaatcatatcagaattatagaagtttcccataatttttggaacacacactaataacatatttatacaaatacagtccaaagaaaaccaaacaccattcactcttctatttgaaagttttccttctattctaacgtcacaatctccagagttattaatcagaaacctgcatttaagaccacctgttacattttacagctggtattaaaaccatttttttttgagacagagtttctctcttgttgcccaggctggagtgcaatggcatgatcttggctcaccgcaacctccgcctcctaggttcaagcgattctcctgcctcggtctcccgagtagctgggattacaggaatgattttgtatttttagtagagatggggtttctccatgttggtcaggctggtcttgaactcccgacctcaggtgatctgcccacctcggcctcctaacgtgctgggattacaggcatgagccaccatgcccggcctataaaaccatcttttaagaggacaaaaatgagacaacaattgcctgtggacgacacaaacattgtagagtagccagagttaaagacacaatcgacaaggaaatttgttacctctgtggcacatagccatttaacataattacaattattactgataacatatactaagtcatattagaattataggagttttacataatctcagaacatatgtcaatcatatatttacacaaatatagcccccaaaaagccaaacaccatttcatatttgacaatgtttcctgtatgatttttatgcaaaatacgccaaatgtcatttttggactttagaggacctaatatctaaaagattaggccagaaagagacataatttataatttgattttggaaagtttgccaaatatcaaaggtttaaaacactggatatcacaaaatagaatcccaggtcaccataagtcattcatttgaccaaaacgataactccaaaatcttaaaagaaaaacctttattctgacagaggagacttagctttccaaacaagacccaataaagacagcatgaggataactgaatttgtctcttctctctccccttttcccctgccatttacccaaaggagaaagccaaaccctttcattatcttttaacgttacaaaaaaatcgtcttcaaaagagaaaaccaaatttcatgttcgcattagtgcatctttaatgctaaagctagtttttaaataaaattttatgtatctatccagttttaattagtttgaccacaaggtgacattctcataaactttttagaacgctttataattttccattaaacagcagatcaattttctaagaagaccctgttatttggacacatgggcccagattctggccccacagtatgactttaatattttaacctatagaaaaagctaaataacctttttcaaatcttagccaacttgtttatacccacagaattttttttttcaggatcaaccctgtataaacccttttcactttgcttaaaccctcagtttcgttccgttactcttttagtttaagacagtctttaaaacctctgaactagacaaaattacattctcttcaacaaaagccatattcctatgccttattatctttcaccaaaaacacattccctacacaccttgtatgtaaaactgtttctccagtaacctcgatttcatgttacaatgttaactcttagcaactttgatttttagtgaaaaacctgataaaaaagctattttaattatatgctagggatggagcctaggacatcagacagaagtgaagataaggtctgactcttttcagcatagctaggggcatagctctccacgtgtccccaggcctcatctataatataatgctccaaagtaaataaattgaacaattttccaaagtcaaggaaacagtttgaccttaaagaatttagcaaatctgatagctgaccttaatttagaccaaatgtctacattttcaagatattttactttaacaataatctttaaaattgtctttattgccaaaagattactaaagtcatgtgaacaaaaagtcatcaaagtttctatttttctgacaaaatatttttttatttaagcacttattttccaagccaattaatcagagctcttttataaacatcacacacacacacacacacacacacacacacacaaaaacacatgtaaatacagacagaagatttggcactgataagactttttatttgccagtttcttaatcagattactggcttcagggtggagcctttggaggaacagggccaggaaagtatgcatttctaaggcttaatcacagctgaaggcaaagacagaactcccaaattaagggcaccattttatactgcaacccaaaaggagagaaatactacgggagaagacagtacagtgcttctaccctacatttcttttcttatttttgtttctttctttctttttaagacggagtctcgctctgtcacccaggctggagtgcagtggtgctatctcagctcactgcaacctccgcctcctgggttcaagggattctcctgccttagcctctcaagtagctgggattacaggcatgtgccaccacgcctggctaatttttgtatttttcttagagacggggtttcaccatgttggccaggctggtctcaaactgctgacctcaagtgatccgccctcctcggcctcccaaagtgcagcctcccaaagtgcttggattacaagcacgagccacggcacccggccataccctgcatttcattgcaaggcaacccaaagtcaatcagcccattttgtaatcagcccgtccttcatgggagtctgatctcccagtggagggtgaggaatgtttccttatcttccgggtgaccaaaagcatgcttctctggatccaagtgtgcaaagagtcaagtatccctgtataactaccattagccatcccttaaagtatatttcctatctagttattacacactaaagctccctcataatgtgaagtaatttctgatatccccaaaactcaaaaccatcagataacacaatgaaaaacagagcagagtctttgattttgagagggatccatctgtttttaattcctggggtttcatgtggaaaacagttttttttttttttccctaaaacgggttctgtggtgcctcctctgtttttcccaatgagtcccaggctaccagaagttatcttagggactcacgtgtgcgttaagagtggcaagacaaaaaaattaaaaaagagaaaaaaatggagaaaaataattcagtcggctgagaagaaaaaactttttccaaaaaaacaagttccaagaagagaaaaacataaaggccttttaaatatatctatagcttgtttatccactcttaattaagctgacttttaaccatagtgctctttaaaaaagaaattcttttagatctcttattacctaattttagccatgccaagtggacaatatttttagcttctgaactttaccaaaggaaacctcctaggtgctgcaaagacatagtaagaagtttctttttacaagatttagaatctccacaaggtagtccagagaaaggaaaattcaagagaggaaatcagaaaagaaacttaataaatggcaaagctacacaaataacaaatcagaaaggaatcattccagaagccaacaattgaacccaggccaccactgtcaaaagacaaagccttagctactgagctatatacagcgttgagaaatttctactgcttttcccagaaggagcctagagaagccagtttcaggcttgcaaggcttttaactgctcaagaaaaatcttaggagtaactatgacatgaaccccaaaattcctgtcctctggatggtagaaaccaaaagaaagtatccccacatggtcacaaggttaagctcttaaggacacaaaacaagacagagaaatttcatagagtattggtttcagggacctgtagcaaagtttgtagctgaccagcctcccaagctgacttgaaaagcagacttatgggtgtcctaacccacgttctatcacgtgatatccctctctccattacataacacagaaagacaaattcttagcacaaactacatcagatgtgctaagattagtctcacaaatccttctttctattaaccaaacccttgcagaggagacaaatagtttactatttaacaatgcagagaaagagagagagagagagagagaccagaaacttgactgataagaatttcttacccttattgctgggatgccaggtttctgggttccctttctctgcagcttccagaagaacggagtggcgtcttacgaccctgcttgcttgtgctatagctgtggggtttaagccactttacaagataaaatcaccctttaccattttatggaaccataaacaagattcttaatttgcaagattctgcccaacgggctgcatggggaactgaattaacattttccaacccagcaaaatacacataacaaaacagacattagtcacctctttccgcacccaatatcagcctggcaaagctcaaaatttttcatcttggtccctgttgtctttgatccacaccaggtggggacggatgacctctgaacggtaattcacaatgaggtctctgggcaagggaaagagcagatagtcaccctgagagacaggactgttgagccttctttagagctcactgaatgtgaccagacaaataaggagggttctctgagttaggcatgctggacttctatcagcaaccccttctgagatccctttcacatatttaaacacatgcaaagacaagagggacagaaggccttccaaatcagatccctaaccaagaagtccaagagtatcccttccaaactatcctcctattttctgtatgagaaacctcctcaaaatcttcctgattgaagagaagtctcccaaaccagtagtcttcctactagttagaaagagcgaactgagacctcccaggagctgaacagacaccccacaatggagtaacagacagagacaccccatgctggatctacagacaccccacaatggggctacagacaccccaccatagggctacagaaccagtcaggagaatgaagcaggcattggcagcacctaggatactcaccaatccagacaccccaaaacggagctacagatagacaccccaccatgaggctacagataccctgtaatagggctacagttaagggacatctccccatgactatttttccattgcaattaagtccacgcacattgggttggaataccccaccagtagacagagtaacagagtcagcccccagtccaagagaattaggcagccacttgggctgccttctggatccatcactgaaagggggccaccaaacaacaggcaggtagccacaggggcaatcctgggtgagcccccaaatttgtaaccacccaaggggttcaccttgcccactgcctagacagagctgactcagcaagacaggggaattgcaatgaagaaagagtaattcatgcagagctggctgtgtgggacactggagttttgttattactcaaatcagcaaatcggtctccccaggcattcggggaacagagtttttaaggataacttggtgggtcgggggaagccagtgagccaggagtgctgactggtcagagatgaaatcacagggagttggagctgtcttcttgcgctgagtcagttcctgggtggaggccacaagatcagatgagccagtttattgatatgggtagtgccagctgatccatcaagtgcagggtctgcaaattatctcaagcactgatcttaggagcagtttggtgggggtcagaatcttgttgcctccagctgcatgactcctaaaccataatttctaatactgtggctgatgttagtcctacagaggcaatctagtccccaggcaagaaggtctgctttgggaaagggctgttatgatgtttgtttaaacgataaactataaattagtggaggttagaagcaagatggagtcagttaagttagatctctttcactgtctcagtcctaattttgcagtggtggtttcaaaacccttatactttattttaccataaacaaatgagcttttagtaatgaattctaatgactgcaatggggtgggggtggtgagttaattgttatcagttgtacaaggttgttttattgtagctcaaatgttggaggaaagggaagctttatggtattatgtttcattaaactaagataggctttcagaattgtacaaaacatttttaaacctatatgtattactgatgatttaagtgagtgtatcagggaaataacttgtttggtgaaaaatggaatatggcctgaaaacataacaacaacttcgtaagttgtccattttctcataaaaataatattgacttacttatatattaaattagtgattcaatttctaaaggccttacaaagatataattcagtattttatggtaattattttctaattagaaatttacttttactatagcactaagtgccaccagtattaattattgttatttccttacaccatacttgttcctagtaaaacaagcttcagccactgttctctataaaatatggtgtcttctagatgggaacaagaatattttacaacacataacctcccatttctagggttgtgacaaaatgcattttatttcaaatggcacgcaatattaaaacaactcagtttatgtttcattaatcaagaattcaaaacaacctcattttgtaaatccataatatgcaaacttggctacagactgtccaatcagattttattctcctttcaagtcagattttccttatcctctttacttacactatcttaccaataggctgtcagatgctagtatgttctgagacattcagtatctcttatcactcaccactcatatactctcagggataaaattctgtagaggcactcaattcgcatagaaacaaccataaaacccagttttgcaaatattaagttagaaaacaattggcatagcattacactatggtaatacttactatgcactcctaaaatttagtgttgatcttatgccatgatgtaaaaacaaaaaaagaaaaaaagttattagtacaaagagaaaaatgtcagatgtgtataatataacctctgatttgactaaaatatgtgataacattcacaagccagaattgagtagagctggcagttcacagaaggcctgaagcctagatgtaatcaatgacatagctgaacttgataaatcaacacatttacataaggaaaatatccctgattatcataggattgaaccttctaaattatctgttgacagtcaatattctgatcattttcttcactgtgaattcagacagactatcattcaaaggtttgctatacagaaagagaaaaataccaaaatgctaaggcacaaatatcaaatctctttcccatgaaaatcagataatttagaattttttaaagttaaccttgaaatgtgactatgtaattaaaaaaaataaaatacttttttgtgataagtcaaaaactaattataaggtagaacatttgctaatatagatttcaaagcaacacctgttaataacatatgttcccattttaaaagtaggtaacagaaattaataactcatagttatataatggggttccaagattttatagtatgaaatgtggtaaaaggtttggtatttattataggatgtgaaaggccccctaaagcacttttaattactcattcatgaattgctaattaatacttccaaactaaaatattaaacactttagaaagactgacccaatattaaaatccaagctgttagattttaaagtgtatgttaaaaaatatttaaactataatatctcttagtgtatatatacacacaaatatctgttttcatatatatgtttatatatattttatatatgtatataatatatatacatagagagcgatagagggagataaaggaagggggttttgtttgtccaatatattttagctgaccacatcattttatgtatttttttatttaaagggccaaggaataaaataagaatgcgaaggtagaatgcagcactttatcctcaattagaaaaatgcagaggaatttaaataattagacttttccacaaatgttatgtttgttgccaggaaacacaggtgcttctaaactcactgctttaggccatgcaaaatttaggagacaggccaattcccctcctctagggaggaaacttgtcagtcaggaaagctcaagagattagcatccaaagccagtttacttctggggctggttaaaagctttcagaggattcctgtgtaattgctaaatattgtaggctaaattaaagttgttatttaaaatgtaaacatcaatagcaactaacatttgattcttgctcttggtataaaaaagcaataaaattattaacaccttggaaagatttgaaaattcattggtagcattaagcaagtaaatatctagcatttagttcatatggcgagaccaattgtgagaacttaaaatacatatttgtgttgatgattctggctactgtttgagaggttatattgccctcttccccaaggatttctcaagaaatgtttatttgatttgtatgatacatttccagctttgttctcagaaatgtcttttctactcacattcattcattctgttcagtacaatactgtgttcattatgctgaggctttaaaattagaaactgtgggggtttgaatcttgtttttgccatgtgatagctgtgtgaccttaggcatatttcacagcctcccagtaaaataaagataaaacagatctttcttcatagaaattatttcaagcattcaatgaggatattaaaatacagaacttagcacatggtgacaaaggaagtactcaataaagttggctcttataattatgatgtagctaccctcaccttcttgattatttctgagttctttttggatctttatgacttctttatattcactagtccctctgcttacgatgaattttttctatgtctattgaaattctagatgtcttcaagatgtcacctcctttacgaaactaatcttagctcccccaaactgaatgcatcattctctgctttgcggcccatagcttcccaaagttacccctatttcagtattcaactcaatatattttattttatttttattgctttttgagatggagtctctgtcactcaggctggagtgcagtggtgaaatctcagctcactgcaacctttacctcccggaggattcaagcaattctcctgtctcagcctccagactagttgtgattacaggcatgcagctaatttttctatttttagtagagacaggggtctcaccatgttgatcaagctggtgtcgaactcctgacttcaaatgatccatccgcctccgcctcccaaagttctgggatcacaggtgtgagccactgcatctggctttgactaaatatattttaattgagttaatatgggatctgccttactgtgaattccatgaaggctgtgaagttatttaattcttctgtactttgtccaaagccatggaagcaccttgcaattggtagaattcaacactgggggaggatcttaaagtaacgaataaatatgtcacaatcgtatgtgcattagagagctatggattctttaattaagaagctgctaagagctactcgggaggctgaggcaggagaatggtgtaaacccgggaggcggagcttgcagtgagccgacatcgcgccactgcactccagcctgggcgacagagcgagactccatctcaaaaaaaagaataaatattaattaccagatgacatattaaatatttttataattctgatattaaaacttataataaaataactttaatgagtggcttggaaattaactgtttaattttcaaagaaatattttgcttttttgaaatgaaataaagacatttcttgttcattaatgactggctctggtaaaagtgacacaaaaaggtgagtgtaacagtgttatggaaaaagatgaaacaggatagtaaaataactgagagatgagcaaatagcctggcccatccagcaacgtagacacatatatctaaatgtgaagttggcgggttcaaacgaatattggcgccatgaggaggctcatgatatctattgctactcaattcatttttttttttttttttttgagacagagtcttgctctgtcacccaggctggagtgcagtgtcacgatctcggctcactgcaacctctgcctcccaggtttaagcacttctcctgcctcagcctcccaagtagctgggactacaggcacgcaccaccacacccagctaatttttctatttttagtagagacggggtttcaccatgttggccaggatggtctcgatctcttgacctcatgatccaccagcctcggcctcccaaagtgttaggattacaggcgtgagccaccgtgcggccctgttgcttctccattcttaactgattgctccagctttacaaaatgataaacccaggaattgtgtctcacgcctataatcccagctacctgggggactgaagtgggagaataacttgagcccaggagttccaggccagcctgggcatcatagtgagacaccatctcaaaaaaaaacagcctgataataaacgtcagtataaaggagatacaatgtgactctcggaaaaatttttaaaaaagttatgaattaaaaaactttgaatcagccttgctaaaagtaaaagaacctaaagtacacaggggtatttgatgaggagcccttagaagtaatcttgttgacctaagcatattacaaaaattgaaattaatgagctaattattattcttcacggtaagatacagaagtagagttcagagaatatttacattttgcctctacaaaaggacgtttaaaaaaaaagaagcctctcgggagaaaaatgaagtagagcaaaggacttactcaagtttaaatttgcagtaactctgtctcttgatttcacaaattaaggagaaggagcaagaagttcccagtacatccaatcatacaactatgaagttccctgacatatttaagtatgtatctataaaaacccctaagatactcaatcatgtgagcacaaagttactgtgtaatcttccatagatgtaaactttaaccacgaagtaagtgatagctacaaagcttgtaaaatatgtttattaaaggaaattgattttttttcagtcaatctagaggaaatggcttcggagatacatggaatttgtttgcttcgactggccatctcacaaagctcattggacttataataatttagttaacaccatattcatgtctccataaaaaccctcataagccacgtatatataccaaaattacatacatgtatttacccacagctacaaatatagtctatgtgagtttcatattaaatgatagtatagaatattattctattctatactatattattatagaatattctattctatattataacatatatattatatataactcgatattatatatatacatttctttaggagatactcatggctgctctgtgtccaactacatttgggagtcacctcttactgaatccttttatatactgggtcacttgcaaaggcttaattgagcatttgactatcatatgccacagaatggatcggacactataaataaaacacaaaagagagtttgtcttttctgggcttcatcttcttaaaaaaatcagctattagacaagcatatgtctaattatatatatcaagcatatgtcatattatatatatcaagttatatatgttaaacatcatacatatactgtaggtagctttttgtggtcacaaagctttactattattatttttatgtacttcttgagaaaaggctatctataacaggataattttaagtaaaaaaagcttaaatctttcagtcaatgttcatatattatcctcataagaacaatttgtgttaggtattcttttctattttaaagtagataaaatataggtacaaacatgttaagtaatttgtctgaggtactagaggtatggcgagaagctgatctcaagccaaaatgtaaaggcctatgtttttctgattctcctattattttggttctatgagagaatgttaaagaaaacataactttttcccaactctcagtccaggactgagaaatctcaaacactaagcatatgagtttgtgagcgaaggtttgcacataaatgtatatactcacatttatgggaatatatgatctgtacttaagccataaactaaatttaaaatttatagtttaaacatgatatttcaaaattctagtaaagcagacacacacttctatttacttttctatttatatttatgtatcttctggtccttttactattttatcaagatacttgaaagcagggatacttaaccaaaagctggtttaggaatggattatgaatggcttatgaatggattgcaggagcatttgaactgctggatttttatgtaaaaggttgtatgtaaaggatattcactgtgtatttttctgaggagtcccacagcttttatcagactgacaaaggatgcatgaactaaacaaattaaaaagcaattaaggtctttataacctctatacatagaaagttctatgttttttctactttttatttccagctggacaaataatgtcttgtaaaagtttagttcactgttttctcccttcaagcccccagtgaagtaggagatgatgttatctatttagtacgggctggagataataaattgtgaacaaagtgaagaatagtcatgaaggctgctttacagaattggaggtaatttggtgtcttttatttactgcagctaaaaggttcttcaaaataagcataatctttgcttcagctacatgtgtttcttccagattttctaatgctcttccacatcactgttttcttggttcaccctttacattttagataaatattccacagtgagaccttcctgatcccaaacctgaattaaataaatactcttacgctctctcatgcacttatttttatttagaaaatttatcataattcttgactacttacatatgcttgtctaatagctgatttttttaagaagatgaagcccagaaaagacaaactctcttttgtgttttatttatagtgtccgatccattctgtggcatatgacagtcaaatgctcaattaagcctttgcaagtgacccagtatataaaaggattcagtatgaggtgactcccaaatgtagttggacacagagcagccatgaatatctcctaaagaaatgttccacaggctgaaattaaggcataatctctagaaaaatgttttttaaaagttgtgctttataatatcacatttatcatggaaatatatctgatcattatgtatcaataacagaaatgtgtgctttactattttctttaggttttgctaaaacttactaccaaatatcctgaaattaatttcactttaaagctaaataaattggtctatatacactaaagtcataagtgaacattttcttttagtagacaattatacaaaaaaattcccttttcctgaaggcatttcttgtctctgaaaataagaattttataattggtcttattttccgttttctttggcttctaggggtcccagaataacatacgaatcaattatttatcttcttagccaacacccttaatccaagcaactgacctcttttgctttgattacattactttcaatacattctcataacctcaccaataaagagctatttgacagatgaatgtgatcaagacaccctttgcttacaattcttcaatagcatactactgcttttaagatagatatccgaactcaggagctttcatttcttgaatgaagaggcttctgtgtagttcctcctcgtcttgtagcaccgtaattttcttttttatttatttattttattttatttatttatttttgagatggagtcttgctctgtcgcccaggctggagtgcagtgtcacgatctcagctcactgcaacctccacctcctgggttcaagcgattctccagcctcagcctcccaagtagctaggattataggtgcccgccaccacgtccggctaattttttgtatttaaagcagagatgaagtttcactatgttggataggctggtctcgaactcctgacctcaggtgatccacccgcctcggcctcccaaagtgttgggattacaggcgtgagccactgtgcccagcctgtaattttcttcttagatatagttaccctggcctttctgttccttcccacaataggagctttgcataagctctttactccaacagaataggcttccttgatattctctttctgaatacagataatgtaaatattactttacgttgtaaatattaacatttctctgactgagtgtacgtcttccccattgacagtaagtttcacaaggataggaaacatgttttcagtttttgtcttgttactgttttgttttctcatcatactccagcaactagcaccttttatgtactgtttttaattaaaatttgaatgagtgaactaaaacatcaggccttaaatctgcatacatatttggctctagtcaattatatatatacttctttattttcactaatttggttgcacattttattatgtctccaaatcattgtgaaagacagtaagcaaaaactgacaaattagtacaatcttggaattcatgtattataaaaggctggttcagattgttttactcaattgtaacatgttttgattgaaacggtgtaaaacaggaaaaaattatctagaaccaaacttttattgcatgttggctatggaaaagtacaaataataactaagacgtaatcaactaggccataatcttgatgagttttcagatttgattatattatatatagatataaaataaaggaattaatattttaataaaatcaatgaaacttcaatatattttacaatagattttaaatactatgttgattttttatgaaagttcagaacatcaaaaagactaatgcaacataaatttgccatgagtttatacgcaccttaaaagaaatgttcgcagattctacttgtatcatgatgggttgcttttgtgacataactattgaaaatgtgtgttttttttttctgcagtacaatcttcacattcagatttaattgtaatcttagccaacttttgctcatagaaggattaatcatatgactttttgtttacacacaatcacctgtagaaagcagttatcattctattcatttcttcattcattcaacaacactgacttttatgctactctatgccaggccctgagtgagttctgggagatactaatatacacttaagttctgccatcaatgaacttacagtcttttgagaaagacaaggcaatagtttcagcatgacttgacaaatcttaagaaaaaagagccagagaaacatagaaagagggatctaaattaggctagaagaaatagcaaggagtagatacagggaggaagggtgtcccagacacagaaatatgcatgtgctatataaaattacataatatatttaagaaagagcaagaaggccgggcgcggtggctcacgcctgtaatcccagcactttgggagtccatggcaggtggatcacctgaggtcaggagttcaagaccagcctggccaacatgatgaaaccccatctctcctaaaaatacaaaaaattagctgggcatcgtggcagtcaccagtaatcccagctactcgggaggctgaggagggagaatcgcttgaacctgggaggtggaagttgcagtgagctgagattgtgccattgcactccaggcagggcgacagagcaagactccatctcaaaaaaaaaaaaaaagaaaaaaaagaaagagcaagaaatttcatgtagttgggatcaagggcattttgaggtaagtaagacagattttaggttaaaggggtagccaagatttttaaattctaaacatatttgaaaggaaaaaatcataatctaattttttattactctttattacaaaaacaaatttggttttaaagatcaataaactacatttttaatacaaagtagtatatacaatatgcatgtaattaccttttgctatttcaagctttgctctgtgtgcatacaaatatatcaatacacatatataatttttaaaatacataaaatcttaatgtgtacaacacacatatgacaacgttttgaatatttaaacaaaagcaaatgacttgctaaattgcaaatatgtacatatggaaaatagatatatttgctcatgcaactgctttttaaaattccattacttctgccaaatcaagcaacactcacacgggtggtataagtacacagaaatagcgaacaacataaatgttagcattcatagatcagccttttatgggaatgtaatttttcatgtacaattcactcaacatattaaaacaatctttttatgtcccttgttatggttttatcagacaagcagaacaatttcaagggaacctaagagtagactatcaatattagtcattgctcatgttgtgtttacaggaagttcactaatttacattcgatttatattaataatcaagagtggaactgcaatgaagtgcaaactttctttttaattctcttttctgtagtgtacaaactcatgtatcagtagctttgggggctattagcactacctccagaatataaacctgtcatattttaaatttgcctcatttcagaagttttgtcttcttatattcaaaggagcatgcttggtatgagtcacagtatcaacttctgcattgaatgttttctaagccatctcaaaatgcatacaaattgttagaaatcaatctcaatttatttatctaacatatttacatgatatccaaaaatgaagacaggatagataatagaaatctaatataaacctgtaagctattttaacaacatcaaatgtatggtgtcccttaagagtgctaaatcaaacactacttcttccagaattttttttttttttttttttttttttttgagatggagtctcgctctgtcacccaggctggagtgcagtggtgcgatctcggctcactgcaacctccgcctcttgggctcacgccattctcctgcctcagcctccagagtagctgggtctacaggcgcctgccaccacgcccggctaactttttgtatttttagtagagacggggtttcaccatgttagccaggatggtctcgatctcctgacctcgtgatccacccaccttggcctcccaaagtgctgggattactggcgtgagccaccgcgcccggccttcttccagaatttttgggagatgtaaaataaagagatgatttaaaaagctctttgtgaatgcatattttaatctttactctggctctggagattttatagaggtaggtaaactaaagttgtgtttctaaataatgtttctgtaagatatatttttaaatctataagttaaaatgtttcagagagataatgcgatctgtttgaagccatgctatattttggagacgactttttttttttttatttttttgagacagagttttgctcttgtcacccaggctggagtgcaatggcaccatcttggctcactgcaacctctgcctcccagattcaaagattctcctgcctcagcctcccaagtagctgggattacaagcatgcaccaccacacctggctaatcgtttgtatttttagtagagatggggtttcaccatgtgggccaggctggtctcgaactcctggcctcaagcgatttactcgcctcagcctcccaaagtgctgggattataggcgcgagccaccgcacctggccaaagggacaatatttctttaggtcaaagggaaagtttacaacaaaccacgtaaccacacaaactgcaagaacaaatatttcccttctgagctgccttagcaaagggtatctgggaatatcaaacagaatgattcataagcaaattataatgtccagaatattcaaattttcaatatcaagtttgtgttttaccagcagaatcaaaattataagaaattatcgagtttggtctcagtatagttctatgtgctataaggatcctccagaatgtaaaaaataatacctgttctcaagaatcttatttaacagttgagagaatgagctggatctgaataaaacacataaactatgattcttagacttttatcacctcagagatatgctaggaaaatactgtattttttaagaatccctttaaaaactttccttaaagcaataacacaagcattctagatggttccacatagaagcagaaaaaaaatacaagaaagaaagctctatataaccaatccctgatttaaaattgtgaaacaatctcaaataggtccagtcccatttcattaccaaacatctacaagtttatgctctgggtttaccatcttttgatatctcctccctaataccagtgaaagggatatggaaatttgttgatacagatgttactgtagaattaatactgacagtgatcagtgaaatttacattggggtggtaattagttattaatgatttaaaatttttacagtgtcacctttactgtcttctaacgatgtgtgtccaaaacagtatttatacatgagactcttttttttttttttttttttttgagacagagtctcactcactctgtcgcccagcctggagggcagtggtgtgatctgggctcactgcaacctctgcctcccaggctcaagcaattctcctgcctcagcctcccaagcagctgagattacaggcactggccaccacgcccggctaatttttgtatttttagtagagacggggtttcatcatgctggccaggctggtctcaaactcctgacctcaggtaattcatcccctcagcctcccaaagtgctgggattacaggtgtgagccaccatgcccagccccaccagtaacattttaagggctcaatagtcacatatggctattggctactatattggtcatgatagatacagaacatttctattgcagaaagttctattagcactatctgagcaatataactttttattgtcactaagaggaacttacctagttatttactctggtctgctagtatgattttacctgtaaatataatacagcatatttggactgcaacacataattgaatctttcccagataggacagaatatatgtatttgttctgttcagaaagattcatcccagtttagcggaagagaaaacgaagcctcaacacctataatagctttttaaatatcacaaaactggtgcttatctatcaaagaatactgacaatgccattaaaattgttgttctctgcgctgtatataaatatactgaataatattggttaatatgggtatgcctaggagcaagttgctaactttctttgaattatagtttctcatggtgtaaaccaattctgcttgaatgggtctgctgtcattggatgtggtataaaaattgtgaggagcttagcataaccataacctagggcaaacccaagcccttctcttaagtagcacggcactaaagacttataacttgagtgcttttcaaaggtgtgtggaggctgtatcctctttactgctccttccctgtgttatatgtaaacaatgtttatttagaaacagaatgcttgttccctggtgctgcaaagaaacagcactcgaacataaatttaactctctcagcaaggtcatttttactttttgcagaaagggtacactcgccagcagttttgccacgagagtacaccgaacaaaggagacagggtcatttataacctgacatgtttactctactgctgtgtccggtttccattggctggaacaggaccacacattctgtatttgtcccgattggctagcaacttagaacttttcaaaagagacaaaggcagaggagaacaaaggaaggaggaagtaacttgtttccacaagttacttgctgagaaaggtaaaaacaccttcaaataaggaagaggaacaggctatgacctaatgcgtgcttggaccagtataagcatgccagggcaaatatttaggctaaattgtgggaactaagaacataaagtacattgatttctttattacggctagtagatatttaagaatgttagcacaggtcgtttaataaattttgcttctaggagacgttactatttattcccatttagatgggtaggaaagtttctttggagagaaacctctactttttacacctgcaagagctcaggttgtaagtggctgtatttctttttcaaaggtcacagctcttgttgggcggtctctcctcagctcctccatttccaggatctagtaattgctccctcacattttaccttttttaggcctagtggtgggttatgtctttctattgtccccagagccaggggccacctgcatcacagtattcattagtttcccttaaccctacccacaactttgaatattgtttcttattgcctctcatagtttacccattttagcatgccgtgtgtttgttttcttgctgatctctgatagataagcatccagagatgatgatatgtctgctattaattaaggatttgttcgtcactccatatgagttaataaaagtccaaaatatgacttaaaattaacaaattttgtatgaacttgtggttgttccatatctatctagaaacatatctctagaatagttctcatttcatgtcgagattaagatatttagtatatagtggcattaactcttcatcttgcccattaaaggcaaaacagattgttttttaattatttcttcaaatggaacttcctttcataaagacaacgtgtactgtaagcattctttactgttttttacagccaagaaaaatcgacatagtttacacacctattgatttgtcataagatgtcaactagagaacaaaaaaaacccaaacagattaatggacaagagtgttaattgcaatgatatataaaaaagccaaaattacataatagctctaacgtaatagctctgacacgcaacataagaagataaagaatgaactatctataggtaatatttaaaaatatatgtagaaaccattaaggcattgttgactcaaggacactggaagagatgctggcccaatccaaacagatgctggtttaaaatgactggactattcttacaaggggcacaccaactcagtatcagttctacagcaaaaccatatgacagaatattatggagcaatgtaagtaatgattaagttttacaatgcaaagttagacaccaaaaaatatctaactttattaaggaaaaaataaactgtttagagaaaggatgttttagctgtgggtggctttccctctgttttaaaattatacttttaaaatttctttaaatatcatgtatttctttgttaaagatggaaacgatgaagccgggcacggtggctcacgcttgtaatcccagcactttgggaggcagaggcaggtggatcacctgaggccaggagttcgagaccagcctgaccaaaatggcgaaaccccatctgtactactaatataaaattagtcagggatggtggcgcatgcctgtcatcccagatactcgggaagctgaggcaggagaatcgcttgaacccaggaggcggagattgcagtgagccaagattgcacagttgccctctagcctgggtgacaagagcaaaactccgtctcaaaaaacaaaaaacaaaaaatgaaaaccatgagtaataaatgaaaatcaattaactcagagtgtattaatggaattatatgtgtatcaagtacaatatttaactaaattataattgtaaaactcctgaatttggatagaatatctcagaaatctacccctaccaattttttcatgttaatatcacctcttctaaaatctcatcagctcctaggaaatgcctagattttaaaaagcaactataacctatggataggatggtccctgtgtggccactaggaagctgctggaagagaaagagagatatagtatattctgtagccatgtgacaagtgtgggaccagaagagcagttagtgaggataattttgcacagcatttgaaattcttacattaaagatactttgttggcaatcgcagcgtttatttgtttatttggttttacatataaataaaaatgcattcctaagcatattaaagaggcacttgtattgttaatgtcctactaaagctaggaaaatacagtttttggatcagatctaaatttaagtctagattctgccacctaggagctgtaaaatcttgtgtaaattactgaaaaatctctctgaaccctattatctatattgatgaatgggcataagagaaactacttcaggccaggtgcggtggctcacgcccataatctcagcactttgggaggccgaggcacgcggatcacctgaggtcaggagttcgagaccagcctggccaacgtatagtgaaaccccgtctctactaaaaaatacagaaattagctgggcgtggtggcacatgcctgtagtcccagctacttgggaagctaaggcaggagaatcgcttgaaccagggaggcggaggttgcagcgggcagagatcgtgccactgcactccagcctgggcaacagagcaagactccatctctcaaaaaaagaaaagaaaagaagaaaaaaaaagaaagaaaaactacttcaaatggcttttgggaagaactaatgtgatagtgtgtgttgaatgcgtagtgcctgatagtgcataattaataaatgtttattcccttttctaaaatgaggaagtaaataatatggtaaatgacattttttctcttttttaaattatattcacaaggtagacttgtttccctctatatcagtaagcttgtttatttttaaactggctcaaggcaattgaagatatttcagataacagaagttaacctttccatcctcttggtattcaaattctttctcctttgataaaactttcaaagaaggttttcaatgtttattccaaatgatttcaagttgacgttataagttcaaattaaagtttgaattcaaatccaaacttcctaaacttttctaagacagtaaaataaccattgttctttaggctcacggacttcatagactgtcacgttttatttatttcaggtttgttgtttgccacaatagacattcttctctttgaaataaaataatatttcctctatttattccttgagataactctaaaatttattcattaaaagaatcgtcctttaagtataattttggaaaaaaagaaacttccaaagaggagatattaccccagaaggctggttttttttgtttttttttttttttaagtattccactttaaaaactcaggtgttacagttcactgagcataatgtattggatttctgggaattaaaggcaatgttatttgacaaagttctaattaactggttgtacagttaaaatttttttcttcaaattttctcatcagataacctctcaaatattttctcatcaaataacttcttagaaatggaggttttattttaaaaaagacagtgttacatttaatgctaggattgaaatcttcctaaagtgggagaataaataataatgatgtatttctctgaatgctttattgattccactacaatttgtccatgtgttaccatgtgttaccatacttggtatattatttcatatccagagtccattcagtcttataagagcttattaaatacatactaatacatatcaaattataaatgaatcagtgggcattctacattttacatcgtatatatgtacatatatatctacatataaatgctcaagcatttagttgttaagtgaacgcttttcattggcaagaaaaacttacttgatgtttaattggttcaggttgcatctcatgcacatacttaaacccgtaaatggcaagtggtatggaagcatataagcgaattaaagtatgattcattttctgtgacaaggggtagtctcatttctttactgaagactactgtgaaattgtgaggatggagatctgagcaaaatcagagttctattggaatggacacaggaatgagcctatctggtaggtgattaaggtatctgttacaacttgatacacaacaagaaatccagtaatattaattggtaagacattcttctagcatcacgatattaaatacgtccagaattcctataaaatctgtacattaagttaatttctttcaaaaattaacttttggttctagagtactttgatgtgtttccataactgacctgtcaggcctctgagcccaagctaagccatcatatcccctgtgacctgcatgtatacgcccagatggcctgaagtaactgaagaatcacaaaagaagtgaaaatggcctgttcctgccttaactgatgacattccaccacaaaagaagtggaaatggcctgttcctgccttaactgatgacattaccttgtgaaattccttctcctggctcatcctggctcaaaaagctcccccactgagcaccttgtgacccccactcctgcccaccagagaacaacccctctttgtaattttcctttacctaccgaaagcttataaaacggccccacccctatctcccttccctgactctcttttcggactcagcccgcctgcacccaggtgattaaaaagctttattgctcacacaaagcctgtttggtggtctcttcacacggacgcgactgaaatgacccattagaaaagcatacttacttatgtcttgcattttttgagctataatttttaaaaaatgtaaactcagaaatgtatggaatcactaaaaaaattatagaaaatgggatctcacagttatgtctttgtaactcatgcacattaaaagcaatcccaaataaaaataatgataaatctagcataataaatcattatttctttaaatatatttttcctaagaacagaacgataactcaaatttaagtgttccaaactgataagtcctcaggggaacactaaaagtgagagtaatttaaaagtagaatatcagtagattttagcaaaagaaaaattgatagtgctcattaggaatttatataatttattgaatcataattacactattgatttacataacagactcctttcacaggtaaactttctcctagagttttgtcatattttacaaattctaaatgagttagcccacttaaatgtttgtttcttaaaattttctagcacagaaaaatatgttaataacgttttaaaataataatgtagtgtgtttcttttgaataaagagactatcatgtagaaactgtcaggcctctgagcccaagctaagccatcatatcccctgtgatctgcacgtacacatccagattgccggttcctgccttaactgatgacattccaccacaaaagaagtgaaaatggcctgttcctgccttaactgatgacattgtcttgtgaaattccttctcctggctcatcctggctcaaaagctcccccactgagtaccttgtgacccccactcctgcctgccagagaacaacccccctttttcctttatctacccaaatcctataaaacggccccacccctatctcccttcgctgactctcttttcggactcagcccacctgcacccaggtgaaataaacagctttatggctcacacaaagcctgtttggtggtctcttcacacggacgcgtatgaaagaaacatttaaccattcttaattcaaacacagacgcccaagtaagaaaagtgaatttataaaattgggtaaaattcacaagctgaattattagttcacaaactgaaatatcagtaataacctaaaatagtgtttattctcaaagacaatgtgaaaactctcattaggcattagaatctacttttcaaactcaaaagtgaatctccttgtaattatcagagctaaatatatgtaaacaaagtaactgatttagttaaagtgattaaacttttttcccattctcccccagttaaaatgaacagtggctaaaaattattatcttaaaggtttatccatagttccaattgcaacattttaaaacgtctattcctacatagaccattggaatagaatagagaagccagaagtgaagccaaatacttaaaaccaatttaccttcaacaaagcatacaaaaacataaattgggcaaaggacagcctattcaataaatggtgctgggaaaatgggacaaccacatgtggaagaatgaaactggatccctatctcctaccatatacaaaaattagctcaaggaggattaaagacttaagtctaagacctgaaaccataaaactcctcaaagaaaacctaggaaaaactctcctggacattggcctaggtaaagaatttatgaccaagacctcaaaagcaaatgcaacaaaaataaaaataaacaaatgggatctaagtaaactaaaaagcttctgcacagcaaaagaaataaccatcaacgtaaacagaaaaccgacagaatggaaaaaaatatttgcaaactgcatctgacaactgaccaatatctacaacctacaaagaactcaagcaaatcagcaagaagaaaacaatctctttaaaaagcttggaaacgacaagaatatacatttctcaaaagaagatatacaaatgatcaacaaatacatgaaaaaatacttaacatcactaatcatcaggggaatgcaaattaaaaccacaatgagatacttccttatcttagccagaatggccattattaaaaagtcaaaaaacaataaacgttggcatggacaagataaaaagagaacacttatatactgctggtggaagtgtaaattaatacctctctggaaaacagtatggagatttctcaaagaactagaagtaggtataccattcaatccacgaatcctaatactgcatatctaccaaaataaaaataagtcactatatgaaaaaggcacctgcatacatatgtttattgcagcacaattcacaatcgcaaagatatagaatccaccttagagtggataaagaaaatgtgagatacacacaccacacacacacacacacacacacacacaccatagaatactactcagccatataaacaatgaaataacgtcttctgcagcaacttggatggaactggaggttattattctaagtgaagtaactcagaaatggaaaatcaaatactgtgtgttctcacttataatgggaactaacttatgagtatgcaaaggcatacagagtgatataagggacttcagagactcagaagtggagggggtgggaatgagggataaaaaactacatattgggtacaacgtacactactcgggtgacggctcaataaaatcccggacttcaccattatacaattcatacacgtaagcaaaaaccacttgaaaccctaaagctattgaagtacaacaaaataaaaaataaaatgtatattccaataagaggaagtttgtagtcttatattcttattgctcagcaaattgtacattaagggcatattgaatattccataaaatatttttcactaatttaattactagtaatcatgtaaagccaaaacataaacattcacagggcttcctggtgatctatttcctcatattttttcctcctcattatttgcctcataatgttttgaacacatccactgtcttcaataagcttcccttacaacatcaaatgtgatttcacctattttcccctattcacttccaacagagattttagttggttatcagatcctgttgtggctgacaggcattagaaatagaaaattatcaagttacttgaggccatgaaattgagggccaaacacagatttccaaaaagcttgctgttttcgatatggttatgtcttcagcccacatcctgtcatgctagggcagttttccatttacagaagcaagtggctgtaaggttttgtggtagtcaggtagatgtcacagcgcaaacaggaattaactcaatacgtataaaagagaaagctttcgaaaagaagtttaaggccgggtgcagtgactcaacgcctgtaatcccagcactttcggaggcagaggtgggcggatcacctgaggtcaggagttcaagaccagcctggccaacatggtgaaaccccgtctctactaaaaatacaaaaattagctggctgtggtggcggatgcctgtaatcccagctactcgggaggctgaggcagaagaatctctttaactcaggaggcggaggttgcagtgagccgagatggcatcattgcactccagcctcggcaacaagagcgaagctctgtcccccccccccccccaacacacacaaaaaaaacagcaacaacaacaaaaaacaaagtttgtgtataatacatgccaagagggtaggaataaaataccatttgctgtcaagatatatttctaaacaagtttattaggaaggcagtagcagatatgaaaaaaaaataggatagggcactggaaataataaatttaaatcagcatttttttaaatttagaaattcataatctccaaccaacagaactaatacttaagtataatttccatggtaatgattatttaaaaccccatattgactatgaatttatagatggtgattccatatgcaaaaaagcaaacttgcatttataatagaaatgagaacaaagcaacagaatgtgtaatatgttgaaggagtcattaactttagtggaggacagtcaagttcctaaagattcatttatttattcattcattcagcaaaaaaatagaattatttagttcaggttataattccagattctttataaattaataatgactttaaatgcatgtgaatttcatagtactgtatatttttttatctaggaatatttttccttaaatgatactattctccgaatttaataaagtaccatttctactgatagattatgacttttaaaaaattggtttataattaaggaaaatatgaataaaaaggacaagctgattgattcattaagaggcaaaattatgctagatattgtatcaacaatatattgttttactaacaataaaactaatgtttccattaactaaaataaataattagaatgactaccatttttgaaatacgtagaacaaataacaaattttagtgcatttaatccctattttaattttattaggtttttttttcagttctactttacatacaagcaaacatgctgagctaagctaatacaaaataatacattttctgttgctgttgtttgtcttctgttttttgagacgaagtatccctctgtcacctgtcacctaggctgtagtgcagtggcatgatcttggctcactgtaacctctgcctctcggtttcaagggattcttttgcctcagcacccccgagtagctgggattaaaggcatgtgccaccaggccggctaatttttgtatttttagtacagacggggtttcactatgttggccaggctggctcaaactcctgatctcaggtgatcggaccgcctcagcctgccaaagtgctgggattacaggcatgatccaccgtgctgggcccagaataacacatttaagaagtgattttggctggccgcggtggctcacccctgtaatcccagccctttgtgaggcccaggagggcggattacctgaggtcaggagtttgagaccagcctggccaacatggtgaaacctcgtctctactacaaatacaaaaaattatccaggcatggtggagggccaactactcatgaggctgaggcaggagaattgcttgaacctgggaggtggaggttgcagtgagccgagatcgcgccgttgcactccagcctgggcaacaagagtgaaactccgtttcggaaaaaaaaaaaaaaagaagaagagagagaagtgatttaaacctaagtctgttcaattttaaaacttgtaatcttaaataaaaattatatttagaattatagtatcaattttattggccagttaaaattttaataaagtagatatatatgcaatttgtactatcagctatagatggcttgtttgaccacattttaatgtgttacatattttcatttagtatagttcatcctggaatattaagttccctagatcaaccactttttaatatatactcatgctattgttttgaaaattagagataactgtttagctttaacataaggctttagactggttaactagtagtgtccattcaggtccctgctggtttctgtttgaaatcaaggccaataataacggtcttaaagaggattattggaaaagttaagatgtgaaccttcttgctcaacaaagaatgcaagcaaaattgtcttaatctagaacagtttgaaaacactatcttagtctattagtgtattttttcagtccggtttgtttcttctgcttctttaaatcatagttgtttttctggatgaacttcattataatctggaaattcacattgacatttctcccagaaagccaaataaagcacacatttagaaagcctaagtacagcatctaaagcttccttgaccattataactgaataacagccgtgtagtgtagtgctaaaaaaaaaaaattattccagttacatggttcagtctcttgagatttacaggtagccaattatggcccacaggccagacaagtgactgatcgttgtctgaaaacaacgacgaagtggggaggtgaaaaagatttacggttttttttccccttacaggtagatgttgtttgaaataatgagatttaaaacgctaatgcagagctttgatctcttctttgatgtttcttgcctgttgtctatatgaaatatagtcagttaaaataaaaagccagagaatagtttctactcactaatgattaataaaaactgcttggcaaatgcaatcttgcacattgacaaatgaaaacagaataggatgcccaacaatggtttaaaaaaaaaaaaggtttttttgtttgtttctttgtttgtttacattgccacagtacactgctctttgttccctgaccctgcaagctctcaccgggtgacttcgactttgcacctacttttctcttttttagaatgccctctctcacatgttaccactagagaaacaatcacgtgtgcttcaaggccaaatcaaaaatttcctcttcagtcctttggactgagagagttatgcccaatttcacagcatatggtacaagcctctgttatttttctgtaccatggtattatatgtacttgcctgtgtctcttctagatatggggtccttaactatttttgtgctatggatccctttggcatctggtgaagcatatggaacacttcccagactgttttcaaatgtgcaaaatgaaaactaaaagcatataaaaaacaaaggaaattaattatattgcaattgtaaaatactgaatataatactattatatgctattaatacattagttataagcataataattaatacaaattaaaagtagtgattagtatactaaccactggtatatattaacatatgatttttcaagatatccaaaacaactaggatttgatataaaaatattggtaataaattcacagatattgctaataccgttctgtgttgcttatcttcataaagggaaagaaatgcaaattttcagttacaggttagtgaaaataaagatgtaatttttttcctatcatggttcatggaccccagattaaggacactgtattttgactgtatggcttcaagggcagagtttttatttgttcatctttgtgtctttagtacagaacagaaccatgggcacaatccaagcctattgaatggtggccgaattgtgtattgaacgttcaaatgtcagttctatcactgcccttatcacatcacaagagagaaatttgatgttcattaaaattaataattttaaaaaacattttaattaaaatatttattataattaaaatctgataaacttgtcaatgggtatgatacgtggcactgtgtatattcttttgcttatacacagatgcttgaaaattaaaattaaaaagctactgcaactaagcactcagcaattgtcatatttttctccacttttccctaagtcaataggcaaccatgaagttgacaatgttgctgataacattgtcatactcaacatcatttcccacaaagcttaaacctctacagaaactcagcagtccctacaacacatccttgaagaatgagaggggtgtcaataatttcagctgctcaaatggaaggctctgacatcaaggaatattaagtggcacattgaagggaattctactattaagtaatgaaggtgaggaaaacaatttctcaatccacggttatttctttgttatactaagaaccgtgcccaatacttatggaacaaaataagcctatcatttggacgtctcctatcagcctgaagcctgatgtcatataaaccaataatctgtgattgaatttttcagctttcagtgttttatttttagcataatatttggtattgccatacgtgacttattattctgttcaatttaatcaaattagagaataaacaaaacgacaaacataatttctcttaatgtgcgtgtgtgtttttcttttttgagacgaagtttcattcttgttgcccaggctcgattcgagtgcgatggcatagtgttggctcactgcaacctctgcctctggggttcaagggattctcctgactcagcctcccaagtaactgggattacaggtgcctgccaccacgcccggctgattttttttctatttttagtagagaccggggtttcaccatgttggccaggctggtctcaaactcctgacctcaagtgattcacctgcctcggcctcccaaagtgctgggattacaggcgtgagccagcatgcttggcttaatgtgttttaatgacataattccaacaaccatataactatattagtacaaaaagcaactacatgaaataaaaatctcaattgtttgccaaatggatacaaataatatatattacatatattatatataacatgcatataataaaatacacagtagtctgcctcttatccatggttttggttacccatgatcaactgcagtccaaaaatagatgagtacagtacaataagatattttgagagatagagaccacattcacataacttttatcacagtatattgttataattgttctaatattagttattgttgttaatctcttatggttcctaatgtatatattaaactttgttatatgtgtatgtatataagaaacataatatatacataaggtttggtattatccacagtttcaggcatccaccaggggtcttagaacacgtatccctacagataaggggagattaattatttctaccattacagaattaaaatgagtctgtgttaatcttcctattcaaaaattatttctaattcagagaaattcaaagagagtctataacgctatgcggtttattgacattaaagacattaatagttaattgcttgaagaagaaaatagactttttcagtaataataacaaatttgcagcataattggaagtgtaccgtcctatccccctttgaactataaaataatattttggtaaaatatggtgaaggatccttacagtgtatcttgatcatagtcctcctgagttataattatctacattattatactaaaattgtggctcttcctcataagatattaatatattcactatatgaaattaactaattgcatagctccaataaaatattaacttattcaactgttaaagtaagaatatcggccaggcgcggtggctcgtgcctgtaatcccagcactttgggaggctgacacaggagaatcacttgaacctgggaggcagaggttgcagtgagccaagactgcgccattgcactccagtttgggcaacagtgagactccatctcaaaaaaataaataaaataaataaagtaaaaatattaattgcatacaaaaaagaaatatgctggataccgtccattgtattagcaatttcaaggctaaacattacttttttttttttttttgagatggaattttgctcttgtcgcccaggctggagtgcagcggctcaatctcggctcactgcgacctctgcctcccaagttcaagagattctcctgcctcagcctccctagtagctggaataacaggcgcccgccaccatgcctggctaattttctttgtatttttagtagagacggggtttcaccatgttggccaggctggtctcaaactcctgacctcaggtgatccgcacgcctcagccgcccaaagtgctgggattacaggcatgagccaccgtgcccggcctcaacattactttcgatctcaagactggaagtgcagtactcaacaaagtaattggggaaaaaaatagtttttgatgtaaaaattttagagttcttgatctttgaatgaagttggtctcccaataaatttcaaacgaataagaaacattagatttgtttccttctggctctagtatataggaaagacatttgcaaagcaggtattccaaaatatgaggcaaaatcatcattcttgcccccccccccaaaaaaatcttctagcaactgttgtaacacagagccattataatgtaattagacagactaagaaccagatgctaaggaagcaaaatataaaagatgaagcatgatattattttggttaatgaatttaattccaaatgttacaggagtgattcatggactttttttttcccaaaagatcagttgtcacatgtacatattgcattttaacatgatgtttatgtaatctaatgagaaaagtaaattctcatgtaatattagatgtttcgaaatggataaactgcagacacttccacgggtagatgaataattcgtcaatagtgataagttaatctttaaacttacccctcaaaatggttaagagttaggttatactataaatgtaatataattccataaaaataaccaagacaaaaaatactttagaaatattgaaaatataatatttgttttcctctaatatcctcaatctggtattattgtgtaattcgaatatatggcaatattattattatttttttttttttttgagacagaatctcacttttttgcccaggctggagtgcagtggcatgttcttggcttactgcagcctccacctcccgggttcaagcgattctcctgtctcagcctcccgagtagctgagattacagatgcccaccaccacgcctggctaaattttgtatttttagtagagacggggtttcaccatgttggccaggctggtctcgaactcctgacctcaggtgatccgcctgcctcagactcccaaagtgctgatattacaggtgtgagccaccaccgtgcccggccagcaaaataattcttaaaattcaacttaaaaattactccaagaaatgtgtaggtaaaagtcaaaacactttagtaaatccacattttgtatttccatttatagtaacctctagtgctcattattttgaagataaaactttcttatacagtaagctttttaaaatgtgagaccaaatcaaacaacaagagcgtaatgaaaaacgatagaaggaaaacaactaaaataagaacctcctagctcagatttattctaaaaagttgaaaataaatataatgtagaagttattattatgaaaacataaataataatattttttcatagatagtaacactagctttactctgaaagtagaatctgtgcttcattaatagtgcctgtgtttaacactttgataactcaccatacagaagtatagcctcagtgttcccagattcctgttcctagggatgaatgatcacattaggaaggtacattcctgttaatttggctaaatctgccagcccaaatcataaagttctcctaaagatgctctatctcaagagcaaacacttaggaaaattgttaatgtttataacaaggcaatcaacatctcatttaaatattcagaaattgatccttccacttcatactttcagttaggatgagcattgaaaacatgtagtaaagcacaacctcagcattcataatgaatatgataagaacaagccttttctcattcatgtttactaccaaacatctgttgaataaactacttaatccttacaaacataaccagattattttcagcaacaatacaaactctatagtgataacagctggtcctttactttcttcagggatatacactccacatatatttcatttcttctcaagttaagtgacaaaaagctaaaatggattgtgatgcagtcaaagccacgaatgacacagttttctaccatagacaaggggataattttttttttctttcaatgtaagccacaagtgtaatggggggatctcctaaacgaaaggcattatggtagggggaggttccttttcaagaccacgcctaaactactgataaatatgataaatatatggttgtaaaagacaacatttctttttttttttttcgagatggagtctcgctctgtggcccaggctggagctcagtggcgtggtctcggctcactgcaagctccgcctcctgggttcacgccattctcctgcctcagcctcctgagtagctgggactacaggcgcccgcaaccacgcccggctaattttttgtatttttagtagatacggggtttgtatcactgtgttagccaggatggtctcgatctcctgacctcgtgatccgccggcctcccaaagtgctgggattacaggcgtgagccactgcgcccggccaaaagaaaacgtttctatgaacacagtattacttatacaatatttaaaaacatattatttgatgctcaatgttttataaacaatgattcaaaaatgcagagctgggtgagcacggcggctcatgcctgtaatcccagcactttgggaggccgaggacagaggatcacctgaggtcagcagttcgagaccagcctggcccacatggtgaaacccatctctactaaaaatacaaaaattggccaggcatggtggcgtgcaccagtaatccctgctattcgggaggctgaggcagaaaaatcgcttgaacccaggaggcagaggttgcagtgagccgagatggtgccactgcactgcagcctgcgagacagagtgaaacccagtctcaaaaaaaccaaaacaacgacaaaaaaccacagggctggccgggcacagtggctcacacctgtaatcccagcactttgggaagctgaggcaggtgggtcacctgagctcgggagtttgagatcagcctgagtgataaggcaaaaccccatctctacaaaaagtacgaaaattagctgggtgtggtggagcgctggtagtcccagctactcgggaggctgaggtgggaggatcacttgaactcaggaggtcaagggttcagtcagccatgatcgaccactgcactccatcctggatgacagagaaaaaaaatgcagagctactgaggtatttacaaagaaatataaagcacagcacgtgctctcaggaaatctataaaaaagttaaaaagttatggaatcaaagttaatccacaggaaataattagcaagcaattatgtcgataactgggtagaaataactatgtggaacaaaagttcatagaaaaaagaggtgtttcaagccgttagagaaagtgttgtggtaactaggacttgaattgaatttttgaagatgggaatgctttagaaccaaaagtcgatggaggaaaaagattccagaaagggggaatcagactagaaaagcaagaataaatgagctggcctgtataggagagagaatattttatgcagagtatatagataaagtaacacagttcaaacccttaaaagtgtatagccagcatagttttctgccaggattcatactgctctcaaatcagaagatactctactagatttaagaattacatagtcaatcagctgaaagccttggaactttcggctacatagtcattaaaaacactactattatagctcaatttcaccaggccacattatatatatatatattttttaacataatgtacacaatacatatatacaattttgccaattaaacttgtttttcaaaaagtaactcattttatctaaagaagttaagctcatcaaagcaaagtggaacagtggtagccagtaactggggatggaaaaaaatggggaaatgctggtcgaaggatagaaactctcagttataagatgagtaagctctggggatctaatgtacagcatgttgactatagttaatagtactctattgttacttgaaatttgctaagagagatcttaagtgttctcatcataaaaaattataatggcaactatgtgaggtgaaggatatattaattaacttgattgtgataatcatttcagaatgtatatgtatcaaatcatcatattgtacaccttgaatatacccaatcgccatttgtcaattatacctcaataaagctgggggaaaaggtacctcatatttattattacattttattgttataacacatatattttatctcatttgacccttgaagtaactgaacctaaaaagcagtatttttagatatgaaaactgaggcccattgaggattaatgattctcaaagccacagggtaagcagtaaagttacaactcctctcatgtgtcctgattacaaatcattacctaacgtctgtaatttccttgcatcatcgagaacctgaaacttttatcataaaaacatttctaggaaatctggtaccatacgctaatcaactatggaaagaaaatccatttttaaaggagtatctcaacttgttgcaatttgcacataaaaatatcctttgtctcatatactacgggacaaaacagaagcagaaacaatgaaataggttcaccattagagatctgactagtcttgaaatgtagacaattcaggtcattagtcatggagtcctaaggggaaaaagcatgcctgattccacactagtaaagccagaagctatctaatttacatcctatacttggctgaggatatcagatgtgttcaggctgaacaagttcaagactcttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtggagacggggtttcaccgtgttagccaggatggtctcgatctcctgacctcgtgatccgcccgcctcggcctcccaaagtgctgggattacaggcgtgagccaccgcgcccggccaagactcttgcttgagtaatttaaagggatgtgacacagtctgaatagtaattggttatttaataatcctgcctgcagtggcaacataagcttgctttactcttaagcactggataggacaaactgtcttactcagtcctaggaaaagaaacgttcatctgaacaaaagatttaaagtcgacctgatgtgaaatcctgaaatacattttgaaaatgaatggattagcgataaaattaatgagaagactaaagtctctgaaatgaaacatttttggcatgtgataacctgatatgctcccctcaaaagtcccttggaattagcctagctatctcagcatagcttttcttacatcatgggtattacattagccaagccaacttgtctatttgtccttgtctcacatcacttttcaccctcaacttttactccatttatgccaatctccttatccacagcaagatgctactttgactttttggcctttctcagcatgcttcttcaccactgtggaagagcttcccagtacaactactactactgccaaccacaacctccatatctgacactaaatccttgcctactaaactgctcattatctttaaaattggcatcactcacttctacttcacacatccactgttcgatatccagccaagcctggactctgactgatcacttcagtgctacatacaaagacaccttagactttacttccttgaactttattgaacatctttacttccttgaacacattgtatatataatagagaaggaggcatataacatgacatatgtcaaaaatatgtcatatatgtcatatatatgttttatatatatatatacacacacacacatataaaatgagctcaaggaagtaaagaattgtaagtattgtcttctttctccaatacctactcctctttgctaaggcatcagatgatgttgtttgtgactcagtaaatcactattatccaccatcaactgaaccatgctgttactctttcccattagtttattccgcaaatacatattaagctactactgcgtgactgacaatatgcatgttagtgtatattcagtggcgatcaaggcagttagaggatggatgaggagagcattccaggaagaggcaatagcagtacagagactggcatttgagaaatggcagcaggtcagtatggctgaaatgcagcaagactgcagaagaaaaggaagaaaaatgaagtgtggttcttggtaaagatattggacgcatcagagcagtaacgaattttaatcagagattgacacaacctggtttatgtttttaaaagctcaacctttaggccatgtagagtatggagtgagtagaaaaggacaaaagcacaagtggcaaagatgagttgggggattattgtagtatctaagggtaaattagactaggatggaaacaaaatatatggatgatatatgtccattttctctgctgttccatgagccttttcttcacttactgggctatctggtccatctcccataaccagtcttctaacccttcctattgatttgcaggttcactaactgtttcctttcgatccacctcctgttcacttttaggtactaaacagagtgaagtcatcccgtgtgagtttcctcaccctccctccctctaacatcttaagtgcctttgccctgttttgtttaagcatgtgaaacaatttctcgctaaccttctgtgttactttagattctccccagacagacactgaggcaaggatttgaggtgcaggtacacagtttatctggcaattgattacaaaaagtacaagtgagaggaaagagaaagtgagattaggaaaggtaaggaggcaatcaaaggtgtgtcaatgagcacattattctggggctcagtcctgctggtgaatctctgagaagctgtgaggaacatgcctcagaattatgcaccagaagatgagatggctgcgtgcttttttcaagtacttccatcccctcgtagttaaaggtcgcttctggtgacattaacacaacccctcatatttctggcttactcctgtttatagcaaagcaagatactgcatggaactcgggtggggaaagaaatatgcggcagaacatcagcaacaacttttacatcttcttatcccttcaggatcttgtttatttctctcctctattgaaacactttttaggccaggcacagtggctcacgcctgtaatcccagcactttgggaggccgaggcaggcggatcacctgaggtcaggagttcaagaccagcctggccaacgtggcgaaaccccgtctctactaaaaatacaaaaattagccaggtgtggtggcgtgtgcctataatcccagctactcgggaggctgaggcaggagaatcgcttgaaacagggaggcggaggttgcagtgagctgagatcgtgccactgcactccagcctgggtgacagagcatgactctctcaaaaaaaaaaaaaaaaaaaaaaaaaaagactttttaaaggggttattattaggggctatatactggatcttataaatcatctagtccaaccctattatgtgaagattagaaaacaaagcattcacattattctatcgatttttggaatgctatttgcaaacttttttctgggcccacttaaatgtataagttttccatattttatgttggttaataagattaaaaccaattttaatatcttgacaccacattgccatttatcaatatgtactacgttttttactggttcctcaaatctcaaatctgtgccagcgtctgttgaatttttataattttgactcaatttatcattcttttttttttttttattgagacggagtcttcctctgtctctcaggctggagtgcagtggcactatcttggctcaccgaaacctccgcctcccaggttcaagtgattctcctgcctcagcctccctagtagctgggactacaggcgcatgccaccatgtctggttaatttttttgtatttttggtagagacggggtttcaccatgttggccaggcaggtctcgacatcctgacctcaagtaatccgcccaccttggcctctcaaaatgttgggattacaggcgtgagccaccacgcctggcctatcattcttttttaatttgcagacttttaagaacaggctaatttgagacacagaaccacaaaagctacttacgttccaaaatgctctgcagaatctctttttgcatgtgctacgtatggcctttgggagaagtacattttttgtagttgttttgtggttttttgaaatgactagaaatatttttagggccctagaaacctccaaggtaagtgtttagaaattgtgcttctaggaatctgtcagtacttttgtaaacattatctgaagcataagcataaacaaatttgaacagcaggctagctcacacagaaatgattttattcattggaatgttctcacatgtggtatactttatttttagtttggtttcatttatgattaataattatgattccaaaggtgcttaaatcagccggccatggtggttcatgcctgtaatctcaacactttgggaggccgagatgggcagatcacttgaggtcaggagttcgagaccagcctggccaacagggtgaaaccccgtctctcctaaaaatataaaaattagtcaggcacggtggtgcatgcctgtaatcccagttactgaggaggctcaggcaggagaattgcttgagcctggaggtggaggttgcagggagccgagattgcaccagtgagctccagcctgggtgacagagtgagactccgtctcaaaaacaaacaaacaaacaaacaaaaaacaaaaaacaaaaatcaaaggtggtgaaataattttgttgaatatttggcactgtctacattaatgcacacactcaatgtatatattttaacttaatttatacttaaaattgtataaaattattttagtcaaagaacctaatgcagcttagccttgattgataatttcattatctttaattacatggcagaatttctcctcattactctttaaccaaaaggctgtggtagaaatcattgatgctcatttttattggaaagtaatttttctagatttcctgataattgagtgataacttcagcactccttagtcacttttcattatgcagacaaaatctgactcttaactttcaaaaaaatatcttaccataatgtattttcaaataacatgagtttaattaaaaagaactttcccacaggttcatgtttaatcttggtttgagtcttgaatatagagtgaagcgaagtacaactttttctgctttggacaaatttagagctgcttgaagagataaaaacaagcggggacctccctctaaaccttccacttctctttctctccctctctcaactgtgttccgaatgctttctctaaaacacagaggctgagttttgactggctggaaaaacatcagtttatttcatgttcttcctttctccagcttccatttcaattccaagtgtggcccaaaagaaaagataggaactgcataaggatgtttcagtcaatgataaactgcatataccgcagtggtcccatttgattataacacgggatttttactgtaccttctaatggttagatatgttttagacattgaaatatttaccattgtgctacagttgcctacagtattcagtacagtcacatgctgtacaggtttgtagccaaacagaaataggatataccatacaacctaggtctgcactacgctataccacgtaggttagtgtaagtacactctgtgacattcacacaacgatgaaattaccttagtatggattgatcagaatgtatccctggtgttaacacataactgtatatatcctgtgtgtgtttgtgtgtcactgaagagatatgattccttcaccatgaggaatcagaaaactgaaaaggtaaacaaattattgtatcctgaaagtctcaaatgagtttttgttctactttcttttgtttttttttgagacagaatctacctctgtcgcccaggctggagtgcaggggtgcgatctcggttcaatgcaacctccgcctcccgggttcaagcaattctcctgcctcagcctcccgagtagctgggatttcaggaacctgccaccacaacctggctaatttttgtatttttaggagagacagggtttcgccatgttggccaggctggtctcaaactcctgacctcaagtgatctgtacacctcagcctcccaaattgctgggattacaggtatgagccaccacgcccggttcaaatgagtttttttttttttttttcagtccaatattaaaacaaacgaaaaccagaatgccttttgttctcacattcaattcataatctaatagctatcagaataaaatgtcatatttattattcatttggaagaaaacaaacagcagtaaaaattgaaataaaaggctgggcgttgtgagtcactcctataatcccaacactttgggaggccgaggtgggcggatcacttgaggacaggagttagagaccagcttggccaacatggtgaaaccctgtctctaataaaaatacaaaaaaattagctgggcgtagtggcgaatgcttatatcccagttacttgggaggctgaggcagaagaattgcttgaacccaggaggcggaggttgcagtgagcccagatagtgccattgcacttcagcctgggcgacagagggagacgctgtctcaaaaaaataaaataaaaataaaaataccctggccaggcacggtggctcacgcctgtaaccccagcactttgggaggccaaggcatgcgaatcacgaggtcaggagttagaaacaagcctggccaacatggtgaaacctcggctctactaaaaatacaaacattagctgggcgtggtggcaggcgcctgtagtcccagctattcgggaggctgacgcaggagaatcacttgaacctgaagggcggaggttgcagtgagccgagatcgtgccactgcactccagcctgggcgaatagagggagactctgtctgaaaaaaaaaaaaaaaaaaaaaaaaaaaaaaaaaaccgaaagaaataaaaataccctgtctttattttcttccttggcaaaattgtctgtaggattcactcatccatttatttaattaatttattgaattcccattacattccaagcaggtattaactactaaggattcaatgatgaaagacaaggtgtataggagacctagtacgtacagccttagtttcttttctcagatttatgctctaaaattccgttaagaatggatttattggctgggtgcggtggctcacgcctgtaatcccagcactttgggaggcagaggcaggtggctcacctgaggtcaggagttcgagaccagcctgaccaacatggagaaactccgtctctcctaaaaatacaaaattagcttggtgtggtggtgcatgcctgtaatcccagctactcgggaggctgaggcaggagaattgcttgaacccaagaggcggaggttgcggtgagcctaaatctcgccattgcactccagcctgggcaacaagagcgaaagtccatctaaaaaaaaaaaaaaaaaaaaaaaaaaggctttatttttatgaagaaaaccataaattaatgtcataaatcttatctatgttaataattatcagttgctttaatcatgaaaacaaaagggaaaaactggcaagtgagccaggctgaaataattcaatataatatttaaagattagaaatatggtacacttgttttctaaagatcagctccatcttatcaaactggaataacatctgaattaaaataatgtgacattgtcatcaaagctctgattattgctgaagcatgtgataggtaggactggccaaaaattaatacattagaaaagttaaataaaaaataatatatatttccttgatatgtttaatcaaaaacatggagaaaataattgtaataaaaatgtctacatccttaaaggcatgttcacccctaactctcagttacgaacatctagattaaatttcattaaaagtcaattatccatattaaacatttaatctaaacgttgcgccccattagaatacatcaaaagcttacattttactaaaagaaagtgactacaatgaatgaacatataactttatagcaaaggttataatttttgaatgtttgactttagttgttaacatttttaaagacgttctaattttttacgaagcattataattaagcaaaatatccagttttttcatagtttcagttttcaaactgtggctttggtaaggtaagttggaaaacatcttagttttaatggcccaaaaggggagactttgatgtatagtatagattcaagtgcttatctcatggatcatgctttcattttactaaaaatataatagactaaaactttacatagggagaaatcgcagagaataagaatcaaaggagtaattaaaaattgagggttttgggaggctgaggcaggagaatcacttgaacatgggaggtggaggttgcagtgacccgagatcgtgccattgcactctagcctgggtgacagagcgagactccgtctcaagaaaaaaaaaaaaaattgaggttttacgtatttgagacctaatgaccaattgtttacttttgtcaacagtaattttactgctaagtaatttaagtaattttactgccagtttcagcaggaatacaatttcctaacatagatatttaatattttattcaatattttaatatattaatctttagtagaatatatgcttcaattttgtgaggatatgtgtttattttcttgtacagtgtaaactaaacaacgcataaagagaacacaggtaactagattaagaacaattattttctgctctttgtattagaacactcattttctgttcttagtaatctagcagcatcagcatctcctaaaaaatctgttaaaaatgcagaggttggggccccacttcagaaggactgaatcagaaactctgggggtggcatccagcaagctgtggtttaaccagccctccaggtgaatctgatgcccactcaaggaagagtgagaaccactgttctaatctatcgtcttccaagagtgtgtgggaagatcaaagaaaaatcaggtcatggggctttgcggagaacaatcaaacaaatacataaatcaaggactctataagcataatttaataaatagacggatgattgtttttaacttatttttcaatttcctccttagtttgtacatgcatttagagataatctcagcaatgtcagcgagcttggtggcatagttcaagctgtgaaggttcaataaataggtcggtaaacattgcaaatcaacacagcttttgatgaaatgtcaggcaagacagggcttagctatattcggctcagcttgaactcataaaccatcaactggcctctgtacttccaggacaatctgatgaataaaatacagatataaaattaaaaaatatatttataaagagattagtaaaacagcaatctgtaagtgagaaatgacaaccacttagtccagaccaaatgagagagaagacttgcaaaagggtaacttttcttacaaatcaagttatgggaaaatttgagatccaaatagacttttaactttggattgtctttattcccaacacacgtttttaatttaatgcggtgtactttatcctaactcttttagctcacccccctgaaaaaaaaactagctgtcttcctaaagatagagaaaacttgtccaagtcagaaactctttggaattttaataaaagtaacataatttagaaattaatatacttcaaatatactgacagtatatattggcaacagaatatatgctaatttagaattttaggatattctataattaaaaaaaaacctgataaatcactacaccttttcactttatttagaagctaccatttaataataagtgtttaacctctaaaatcattctgagatatttcagataattaggcagcctggaattactgtttacaattgtcccagtttgcttcctaataagttgtgcttgtctaaacatgtctaaattactattcacaaggatccttgttatttccgtcttctttgattaaaaacttcttaaaaatgtgagtgtatatgtgtatgtatatatatacacatacacatattcatatgtacatatatgcataaataagcccatatatatatgtgaaacacaggtttttctattgttaatataaaaatccctcattagttttctaatgagtttatgaatgtagtctacgtccttagaaatttaatttgaggtaaaaatattatcgtttatagattaaggtctggatatttttttcttttcttcatactagaaataattttagatacctgaagacaaagttcattaaagccacaacccaaaaagtagaatatgggttccttcttatttcagtgatttgcattatcctataggttattggtgtcaaacccctttcttcccttcctcacaacaaaagccccaatttaacttttatagaaaggcatatggaacaggagtcatccaaatatatcccaggggttgcaaattgaccaaaagagtcacctttagggaagcctgcttctgaatgcttgtggaatttatcattcttctgaatggctgttgcatttatctgcagcttttactcaccagatgagacctcagacatttcaaattctgcggaggctggctacacaccttcataggaaagctttttgctgatttccctgttggtacttttctcttacacattctatggggtatggtaaacctggaggtagagtcatagccaagcacagataaagcaggcacagaatctctgaccagcctcacaaaagcagacaaacacacaatctttttgcacctgtttcttccactccggttgccgtgaatagtgaggtgttctcacagattcagcttcacagacagcattttgcaaacactcccctctcacagcaatggtttcttccctcaccggctcaatctacctgattacgttcccttctaatcagtaacctcagttcctctagaaataactgtgtcgtctgctttatataggatttatctgagtctgaagcagaaactggaaagtagacttagaggagctgattattatgaagacacctgtatttttgtctggtattcacgtgaactcgacagtgcactcatttatgcaaactggtgttagtgaaaaagaaaaagaagcagagaaggaagcaaaaagaagagactggacctataaagttgcgcacctgtgtgatgctaggagaagaaaataactctaaaaacgtccagtgctgctgaaaacacatttgaacttcctatgaaaaccaacagtgcttgacatacaaatatcttcctccagacacacctttaaaaatacattttaaaatctgaaacaatcttaaactcaatctaaaccacaatgcagaagttaattcttaaggcaaatggagattaagaacgaaacttcatccacataaaccctgtgttttaaaaaaagaattaaaaggaataatccgtataacttactcaaatttgtatttgaagttaaaccttgaatcctgcttcttgaaaaaacagaattgtgtcaggcttctgtaatgactgtttacccagagcataagattgaagtggattttcagattaaaaataaaactcttaagtatgtcaatccccatctgatcaaagcatataaactaaatttttccaaggacttcattaacaatataaccaagtagagctgcagttcttggttttctttagagtaagttgttaaaatgattgaagttcatgtaaaagaaatccagagttacagttaaggtttgctttttttttttttttttttttttttttttttagtagatccagtgcccggcaaacagtatgtgctcaacatatgtttatttaatgcgaccaaaagcatacaatataaagtgtcattatcattgccactgatatttttaaaaagccatgttctatacttatttcatttttacgtaagccacaattttacaaggtttcaaacaaaaaaaaaaacccacaccttgttttctttaatataaaatatttggcaattataagcatggaccgtgctggcagtaagttaaaatgtgactgattttttttttctccgttccctactctcaattttcagatgcggaaatttcatttggagagaacaggaggtgttggtgggaaaaatctcattaatcgtaccgtattcccttgtctacaaagagtactgcatccaaattacagaagaactaaagaaaccttgtagcatgagtataattagcagtgctactaagtgaatggaaatggaggttgcctaacttaattaactgtaatcattactcattgtcgtactgcttagaaagattagttgagggtatttcttctgtggtattactttaggcgtttctccttccctcttaaatgtgaaacaattacactataaagaaagaattagcatgccctttcaatcagatagaagcttttccgaacaagtaagttccatgtcctagctcgagggcggcaaaacaggaatgatgggaaaatatttagttgggccaaagttagagaaattaagaaaaaagtagttaattgcagaagttactgacttgaggaggaaaaaaggaaccctatatatgagtttctgtaaagaaattagctcttggccagggaagaaataaataacaaattaagatctaaagggaaaaattaaggataacacagtacaaatacgcagtactgtctgatgaagttgttcacaattgcacaacagtgcaagattccacaatgcaccttcaaggacactgtagctaaggattgctttctgatcatttatccttttagcggaagacacttggcatctgggaacatttgttcttttgaataaaaatcacctcatacctaaaaggaacctttataaatatcagaaaaacaggaatgtctgtgacgacgatcattggtggggcttggcctcattagctctggggccactagtgtaaaaaaaggttcacagggactctcttctagtagggactatatatatatataaatatatatatatatgacggagttttgctcttgttgcccaggttggagtgcaatggcgtgatctcggctcaccgcaacctctgcctcccgggttcaagcgattctcctgcctcagcctccggagcagctgggactaccatgcgccaccacgcccagctaattttgtatttttagtagagacggggtttctccatgttggtcaggctggtctcggactcccgacctcaggtgatccgcctgcctcggcctcccaaagtgctgggattacaggcgtgagccacagcgcctggccgggacttcatatttaatgaggcttttcactgttctaggaattaaactgagtttcaggtattgcattcaagaatcttctcagcaaacctgcaatattggtaatgttattccttaaactcgttttacaggtgaggagattggagctcagagaggtttttcagtcatccaactaaccggaagtgcttaagaatccagctctacctgactccctaaacaagtgtgtgtcaagagttaatgggcatacaaaccacctgggtatcttggtaaaatacgggttctgattcggtaattttaggtgggacctgagattctgcatttccaataagttccctggggctgctgcggctgctgctgctgctggtggtctttggacaacacatcgggtagcgaggcccctagacccgtggttctccaactttgctgatattagaatcccctgaagaacttctttaagaaaaaaacccagtgcccaaactgcacttcatatcaatgaaatcagagtctctagaaatgagactcaagcaattctaatgaacagccaagtttgagaatctgtacccattgacatgttgttatcaaattaggtgctcatcagaatcaactgacgagctcattataaacccagagacctacattcattaaagcagtgataagacttaggcctttgcacatttaggtagaccccccaggtgattctgttatccaacagtttgagaaccactttctagaccatgctccttcaaatcaatcagaccaagccctgcagacaaacttaccattcaggcaaaaaaagttgtgagtaggagcttgttttcatgcatatcctcagggttcatcggtacgataagatatcctccaagctaaaaattcatggggccctcacaccaccacatccccagttacagacatttttttaaacctcttttgtgagtatcagtgtactcattgtatgcttacactgtgtgtgggtttttatgcctgtggttgcgcattaaatctattactttgtcagtacttcaggggaaagcgtatcaatgttgtaagacatttaatatatgcccagggtagctgtataattaaaaggaattgattttgaaaaagaacctaatggtaacctgaaatgaatagacaaaatgatccctaagctcagtaacaactgcagcacaatgtatcaccttaggttaaaacctagttcataaataatcctcaactcctcttcaagggcttgtgaagatgagggtcattttgagaagtgacacattttggcttcaggggagttttagcataactgctgtcagattatatcttcttaaacattttcgttggcagtgaagggaagatgttagatcatgttagaaatgtaactaatggggtcaaaattttacttccttacagctcttaagagcacatacttataggaaactcttttggatatctcccttaatattatctagaattgtccaactattcctttaaatgagcacaactggggccactccttatggctctgggcattgcaccttgcacaaaggtgcttgagtatcatacccacattccccccagccatccctgtgatcctccaataaagcagagtcatactgaaaaaaaagcgtgctttctttcaaaattggctattctgtggatttgggaagtggggaggatgcctctttgtttaattttcaaagagtaccatataagcgggtagcagtcctgcggacaacaaagtgtaataaaaaatgtttgggatttcagttggaaggcattgggaactaattttatgacctagggcaaggtatttaaacttttagcatcaccaggctttccagctataaaatagcttggcaacatgccatagacaatcaacactcaggctccgaagtcaaagcaatttaactagggcttgaattccagttctcctatgtactagctgcataatcttggcacgttatgttatttatatcacatttcgttgtctgtaaaatggggataatatcaattccagcctcctgaggctattgttagtttccactacaaggtgtttaccacagttccagatacagagttagtgctaaataaatagtagctactatttatcaacaacaataataagatgataatcactcacatttcccaaggctttggaggaaattaaatcaaatgatgcatacaaaataagcctttgaagtgaaaaacaccataatgttgttgaagatgggttttcttccttttagtaatatgtttgccatatctttgattttaaagaaatagtagtggttaaaaaaaaagcaagtagtagggccaccaaagatctggctacaataattgttctgagaggttaggctcctgctgagagttggagctaaacctagcacctatatgtagtagtacaaacctaaatatacagtacatcagggaacaacgtagacttcgaatgtacagatttaaaactagaactgcaataacctggtgacatactgaataaattggaagtaagtccattaaatcttgtctctagagttattattcccaataatcacaattttttaaaatgaccatcttgaaaatcatgtttcctggagtcacctccaaatagcagtaagctacccatctcctattacaaaaagaaaaatgagaccagcttgtaaacacattacccaataaagtaccttacagtgcaagcagggaggcattattgctcaatggaagtcaatttaaaataagaggttaccgagctttctcaataagagtaaaggatcccggccataattgttctgcagtaactttggaaaggtgtacttttattcaaaccgtgctatgattttggcttctctcctagggaggaactttcatttcagtaactaagttcatgaaaagccaaactctttgcagctcttcagctggcagcattttttccagtttctacaatctcatcactgtggtgtgtgtctgtttacttaacgattttaagcacaattcttcatgacccatttatttttggatactgttcttttattttgattgcatatctttcccatagggttacagcaagtttgaaggaaaatcaaacaataaaacactcactcaatatcataggggtatttgctttcaaaagtcaaacagaatgaaaatctatctggttggttattttagatgattagtgttaatttttgcacctgatgaccaaaaatcattttagaatttgatataaggaacttttgcacagacatcttacaacatggaatatctctaagtgttaagttttacataaacatgaacatctggaagaacttgagccaacttgggagctattattttacccagcctccttcatcaaacagagctcagaactcccctccgttagctttaagcttttctcaatgaactgagtaatggaatcttgagggacacctttaaatccagcagtagaagcaaaaaccttccccactgataagcaaaagaatatttctggcaacaaaacccatcaactataggcggtatatatctaactcagtcagccttgagttaaacgtgagtcagtaacccctgaaggcaacaacaaaggcttagagtgaaataaaaaagttcgcagacatactgcagaagatccagtctcagagaatgatctgcttaacacttggccctgagattatctgagaatttcctaaaacattcaacacctcacagtgaccacagttaaaaataatgtattataggtttcaaaattgctaaaagaatagattttttaatgttctcgctacaaaaaatgataagttggtgaggtgatagatatgttagtcagctcgactgactctttctacaacatacacatagatcaaaaacatcacgttgtactcggtaaatatgtacaactattatttgtcagttaaaaataaattaattaatttttaaaaaacttcaatacttccaagatctgggaacaactacgtggtaagcccattaatttataactgggactgtaaaccaacagaacgaattcttccacttaaaatcagcctttgattaatggcatacccatatattacgtctcctatatgagaacaacatataatgtatggtatttattatcacaaaatttctagaaataaaataagtccagttcagtaggtataatcctgttctaaatccccatatgtctataatgctgccacatatatcttcttaaaacactagtttcttcatatcacctactgtcattcttataaccccaactcttgataagatagtttccatccattgtccaaacttcatcatctgcctttcatttctcagtacactaagcttgcttctactgaaacgcactattctacaggtttctctctccattagattataagatatttaagaacagaaagactggcttttttacagctttccagtccctagtgcttcctagcactgttcctggaacatagttaccacaaagcaaacatctacttcatgtttcacattgatatataccccactaacgtccaacacgtgttatttaaacaaatactagtctctaaatacttgtacatctgctcaaaaattttataaaatatgctagatcatttctattgtgaaaaattagaagcaaactaaatattcatgaaatagaaatgaaaacaattctggtacatcctattaatatatttatatgcagacataaaaaaatcacattcttatggaatatttaactacgttggaaaaccatatgatatattaagtgaattaagcagcttccaaaactatgtgtatgctaaaatactaaaatgtattattcttagtggttaaaaacctaggctctggagcctgaatgcctggtttagaattccggctccattttataatggcattgtgaccctgaacaagttaatgcatcttgttattgcaccaattttcacatttttaaaatggtctaataacagtacttatattataaaattattttcaggcataaatggataatatttaacatataaggtaattgaaacatgggtatgtaccaagtgctagtaaatattagctatcattatatagttctcaataggaatgtctgtgccaaacaggtaacactggttattcctgaatagcaaaattataggcaactattacctttattgtgtttttctgtattctacttttggcagtgagtgtatattattttgtattataaaaaatcaggctgggtttggtggctcatgcctgtaatcccagcactttggaaggccaaggccagaggggtggttgagcccagaagttcaagaccagcctgagcaacgtagtgagaccttgtctctacaaataatttcttttttaaatcagccaggcgtggtggcacgcacctgtggtctgggagggcaaggctgcagtgagctgtgattaagccaatgcacttcagcctgggtggcagagtgagaccccgtctcaaaaaaaaaaaaaaaaaaaaaaaaaaaaccacaacagattcctcttaaaatatgcaaaatatttactgaacattacattggtaagatgcatacattgttaatggaacaatgctgggatactagatcgaagaagtattgtcatcacgagtagcaagctgcctgtaaaatagtagacattgctctctaaaaatgctgtatttcattagtgctatgggttgaatatttgtgtccctccaaaattcatatgtagaaacataatccccaatgccacagtattaagaggtagggttttaagaaggtgattaggtcatataagcggagccctcatgaatgggattagtgcccttataaaagaggccaagggaacttgtttgcccttccagtatgtgagggtaaaggaagaaggcaccatctgtgaagcagacagaaccctcaccagacaccaaatctgccaacattttgatcttggatttcctgggctgcagaaacagttctgcagcaataaatcttcgttgtttataaattacacagtctatgatatttttattatagcagcccaattgaactaagacaattaggagtaagaagtacgaagaattaccatcattatatatgatgaggttaaaaattatagaaaagatatttctacagaagaatttttaagtggtacaagtttaatacatatataaatatacaagtttagtatatattttatatattcaagtttaaaaactatatacatatatattaaaatttatcacataaaaatacctctctagaaatatcctttctataatttttaacctcatcatttattggaatttgttatggagggagatcgtcccctgctcccttaaagtttatagaaataggtcaatgccatctttcggggctctcccaagactattacaataaaacggggtgtagcaagataaataaaacacacttaggcaaggtgtgctaggatttccaaccactttaacttggcatgaggactattagtctaacagaatgagatactgagaacacatcatcagaagcacttaagcataaatgttctctttttatagtggtggggggaggataacgggagaaatgagtaaaaatgtggtttcagcttctagtttcactaggaacggacaaattagaaagtgaaatgtgagacaatagaaagtttgatgtaattcagcagcactgcaaccatcaattattattttaacatttttggtaaagcttccttttacatccaagaggaccaagtgaaatcaccatgttcttatatttacccatagcatttcttttttatttttatgagctccttcttttgctgaatgaataactatttcagcacactaaaaaattgtgccttagatgtctttctaacagtgcctgtatatggtaagtgctcaataattgcttgataaataatatgcattctgcagttgaggcaaaaaagaaatgacccttttttggaatgaaccaagagagacagaactgaaaaagtgaggaagaagggaaaaataatgaaggaacagaagatgatgtcagataggacttttatcaatgtaagtaaatataattcctatatattaatgaatgtgatatgttacattcatattaaaagtttattaacaaaacatcaccacaatgaatatagttgagattttccttgctatgtgataggtactggtctaagtgatttttatttgttaattttctcatctcagcaatcctatgaggtaggtgctattattaactctatttttcagatgaagaaactaaggaaaaaagagagtcagtgtataaaaaagacagtacaaaaaaagtgtataaaaagagagtcctacagtacagtactgagagaaaatgaaagagttggatttccaacccagaaagtttggctttgagtctgtccttttaaccaaaatattcttaaacatctgtctatattgtctccatttatatatacattaactgaatatttttttaatgtcccttgagttagagaaataatactattacctattcgacaggaagaaacatcagacagaaatgacgtggcctgatcactcagctattatattggcagcaaagcctttctctggcattacttaattcgtattctcacagtaacagcattctcctatccctaattctcagtgctttaggctatttcccaggaacatgctatatagctggaaagagatataagtacaatttgccagcattaataatagggatattgctccttgcatttgctacttctttctgtatctgtctacttttattttttttcttattccctaaacactctatctccattgtgctgattttttgaagatattcatctatcttgattttccttactttttattttctttttgccttggagtagtgtttccttttcttttcatcctggaatagattattgtcatttcaaggcctcccttgtgagtacttttttctcctttttattgccattcttcagcatttttactggtacttataacagttctccttttcttgctggcttctggcgtgggtttgttgctatttcttgttctttgatgtttcgcatatctgattgttccctttctcacccctgctttctgccacgtttacctctttgctattatttgtttcctattttgaaggttgacaactaaggggacagtatcattccttaatgtgtttctccagcttactcatgaaatcagcagcagcctccttcacacataaaaccagtccgggagggcaaagtgactcacgtctgtaatcccagcactccgagaggccgagatgggcggatcacttaaggccaggagtttgagaccaaagcaggcaacataaggagaccccatttctacaaaaatgagccagatgtggtggcgcaactgtagtcctagctactggggaagctgaggtgggaggatcgccggaatacaggagttccaggctgcagtgagttacgatggtgccactgaagcctgggagacagagcgagacccctgatatagtttgaatatttgtccctgccataatctcatattgaaatgtaatccccaatgtttgtttgtttgtttttgagacggaatttcactcttgtcacccaggctggagtgcagtggaacgatctcagctcactgcaacgtctgtctcccaagtagctgagattacaggcacctgccatcacgcccggttaagttattcccagtgttgaaggtggggcctggtgggaggtgatcggagcatgcgggtggatttctcacgagtggtttatcatcatcccattggtgctgtcttcagatggtgagtgtattctcatgagatacggttgcttaaaagtgtttgacacctcccactctctctctcatgttcctgccctggccacatgacatgcttgctcccccttcatttccaccatgattttgagcttcctgaggctttcccagaagccgagaagatgccagcattatgcttcctgtacagcctatggaactttgagccaattactcttttctttaaaaattacctcatcttgcgtatttctttatggcagtgtgagaattgactaatacagccccatcgctaaaaaaaaaaaaaaaaaaaaaaaaaaaatgtctaatcaaagttggaaagtgaacattagggaaatacatattttgtataaataaatcctttggactcccagcttcttcctttgccgatcagctttaagggacagtggttctgtttgacttttgaaaggacagaacaagatccttatatatcacatttctgctatcaatagttaagagtttttgctataaattgaaagtatcatggacacattctttagtcagcagtcactccctgtcattaattaggtgttggaatgatgttctgaaatgctgtttaatttctatgaatttcaagtgggattgcccagcaagtacattgccagcatatgtagtaagtaggtaattttcttttaagattatgaatgttattctcaaaattttaggttgtttttataagggacagtgtacagtttgggcttttgtgttaattggaggttgacaagggaaaaagggatagttttccagcatgctttctaggtttttctaaatagtacaaagatgttcaggaggaagaaaatattgctattttaaatggaatattttcaacgctaacttaagcatatctcagtatttaagcagacatttggatattttcctcatctcagacaataactactatgaccttgaacaaatccctccattttctgattctcagttttctcatctataaaatatgggaattggactaaataactttgtttccatttagctttagcactctatgacttttatccatttacttacacaacactactcctgagaaacatacatttatgcaattatagggataaacacccaggacttcatttaatagattttccttataccaccactgtactgtactggtaacagacactttcccctgtataagtaagctatcctgcagatgctaatggggtgaccccaaaaggccaacagaaattaaagaaacttggcaaaaataaacaaacaaaaaactagccgtggcatacagattaagtatatttacaccaagttatgatttttttagtgacttccccatttaaagttactgatatatacgtgtgtgtatatatatacaatatacaaaatcatcagtatattttcccctagataataattgttaagtataattcaataattgttacatgctgtatacattttaagtgatataaatctttccaacaaacctaaaatgtaagtagttcttttcctaatttccaaaattaagagaggcagagttaagcaacttgcctaaggtcacagtcattaaatagcagcactgagattcgaactcagcaaacagcctggctccagaacccatgcgtctgataactgcttcttataatatggttgtgttcatccattttcttgttcatctattgtgaggttgccagcgtgatttcttcaaaggcctgctggagtcaggaatatgtccctaggtcacagagctcagcaaattttagtagcctaaaacttgactcaattctcctgagcggtactctcagtgtgacctcgctactggtcaaaagttgtaaacgagcagttacatattttttgctgctctcaccaatacatgtcttgctatgtatggccaaacgggttgacttgtgcactcaaaatgcaaaaaagtactataaatatagagtagaaatggaaattggcgacataatatgacaatttaaaaatttaaaatatctgattttcacaagtcttaagagcctcagtgatattcagtatgattggagagtttgaattgtgtaaactttattaagagactagctagaaactcagcagagttttcatggattgcatgacactactttcattttctttgcagtcatcacacaagtaaaattttataggttcaacacactccacatacacctaattgctctctagggtagtaaaacaaccaagcagtgaatccacaaaaacagttcagtgagtttcatttaaaccatgcatacactaccaaaaagtgactcacagcagaggaaattaatttactcgccatgaaaacacaattcttaatgatcccaacactatgacagtacctaaaatttcttgtgtgtatatatttggacacacatgtccacacattttatagcaagaacataaacatttcaaactgaaatgcctaagcaacccttaaagatagcttttgtcaagctaaaatctggtgagaaaatgaaagttaaggcttttattttattttattttttgagatggagtttcactcttgttgcccaggctggagtgcaatggcacaatctccgctcactgcaacctccgcctcccagcttcaagcagttctcctgtctcagcctcccaagtagctgggattacaggcatgtgccaccatgctcggctaattttgcgtttttagtagagaaagggtttcaccatgttgatcaggctggtctggaactcctgacctcaggtgatccacccgccttggcctcccaaagtactgggattacaggcgtgagccgctgtgcccggcgaggcttttaaattggtgaaaatgccaaccattcaatttttactttgaataatcaaaactgaagtgattcaagtagtgattcatcatccagtgtaatctagcacagcaatggagattttgtgtgaaacataccaaaggaaaggtttggggtttttaattgcgtaattgactaattcttgggcacctccttccctcaatcaaagatacatcatctgaatagttcacagcctcccccgaataaatgaaagtgacaggctctgtatttcttaatttgacgcctttcaaagataaggttaatggaattaagtaaccataaagattattgtaaattaaatgttatatccttagatgtctgagttaatttaatgcatttcaataaatatgaggttaggaaacataaaaaggaaaatttatggtactaatttaaatggtacctttccacatctcttgtgcgtgctaaagcataggcttttatgtttgtcaactcacaaatattgttgcagggaagagatagaggtcccaagttgtcttaagaatatggagtcagatgttcagtatgattttaggaacagccatatgaaatgaaatagtcatagctatgaactattgttaaacatcaatagagggagggtacataaatagaagttaatcacaagtaaaataacctaacagtgattatttttattatcataatcatcaaggttagatttacagagcaaaacaaatgcttttctatgttggtttagtgagtattttcacagctatatgtattttagtttttctttaaatttttatatatattaactagaacataatacaaacttcactttggtactagaattacatttttaaaaccattaacgttataatttttacaaggagaaaggtaatgttttgtgatgattattatattattatcaatattggttatctcagaaactgtgcttaatacttttctcatggcaacttatgaagtctttattataatcattttatttataaggcaattgagtcttagaaaggttaaatagatagtataaggtcatccttctagaaaatgagtgacaaatttaaacttagatgatttctaagcttattcttttgactgtagcattatattatgttcctgtagttacagaataatataacacagtgtccaaaaactagaaatcattttattcccttatttagggtagagggctgataataaccttggcaataaaaaaacccaaaacctactgtcacagttcttactgttgatggttttaataaaagaaaaaatgtctttgaggttttccttttatgtggcatctggtatttgcctatatccatgatctatttacagcctctttgaaaattaaccgaatgatattaatagatagtttattttatatagcgttaactcctcctaactttgtacacatttctctgcataatttgaagaataagaacagaggaaatcaacaccgataatacagggaaaaaaatacagttttttttaaaccaagcaagaaaatgcaatctgatgccaaaacaaataaatatgaagaccagagaaaaatctgatatccaaagactggaatctaaagtaaatgatgaagatattagcaatctgttttctgttaaatggattcctctttgttacctttgcacacagcatacattcaaaatattagaaaaaaatcaagtttcaactgtggtttgctttattggcagtaatgtgaaggatcaagtactcaaataatttaagcaaattttagaaataagaggttgtctaatcaaaacacaacctagaaagacaaatattgcatgttctcacgcgtatgtgggagctaaaaaattgatctcatggaggtagaaagtggaatgattgttaccagaggctgggaagggtagtggggagggggtgatgaagaggggcttgtttaatgagtataaaaatacagttagctagtaggaataaaatctagtgttctgtaccacaatagggtgattatagttaacaataattaattgtttatttcaaattaactggaggagtagacttggaatgttcccaacacaaataaatgataaatgtttgaggtaatgaatattccaattatcctgatttgattattacagattgtatgcctgtatcaaaatatcacatgtatttcataaatatgtacaactcttacgtacccacaataattaaaaagaagaaagaaaaacaaaacatatcacaaaggatgacgtagcttgattgatgaattaatagtgtatgcaactaagatgattggagagtgtagaccttagtccatgaaaggaaaatcagagttttcacagagagcaaaagggtgattctatcttgtctttggatttctctccagccatagatgcacacgctcgctacctttgcataccttactccaccatctaaaaagtttccttttatttcaataccactggaaaacccaccatttccttcatcatagattaagaaagagtgggtttttctgaagttccaactaccattgttaatgctttcaatctattgtctattttccatgcttatgattgtgtcagcccatgtgtaactaactcttaccaagttgaaatacgttcactaaggttcttttttgcataagacctgtatagaatagctatatattgaggaattaatagaacagcaatattttttatataccaaccacgagtgagatactatactaggtgttattcatgtatttttgtaacttcacaataatcctccatgttagttatttcatatatgagaaaacatgggaaggctccttccaggctatcttgctaactataaccctagcatttctaaacacaaaatataagaaattcagtgtcttagcactggctattctttccttctggaaggttcttcctcagtttttacatgactggttcctctagacagtcatatctcagctgacatgcctcttcagcaaagattctctttactactgaagctggaataactacccaatcactcactatctcaactcagtttgttctcaatgcaacacttttatctgatatgtttcttgtttatttatcacaagagacataatttctttttcagaaatgtaggctctgtgggagcagggaaatatatataagatccaattacaactcaacaatagataagtcacttccatcattgaagatctgagtttcatcatctataaagtaagataatatttatcagatatggttatcatataatgtatttatataatactaaatatatatatatatacagtaatgtccagtagaaagtatgctgaacaattagtgttctgtaaacaaattttttaagtgcactattctgaaatataccggtctctcatccttctcattttattttttaaaatcattttattgagctataactcacacaccacaaaattcactcttttaaagtgcacaattcagtgatatatagtatattcacatagttatgcaactgtcaccactttcttttttcctttatttatttatttttttgagacagagtctcgctctgtcgccaggctggagtgcagcggcgcgatcttggctcactgcaacctccacctcctgggttcaagcaattctcctgcctcagtctcccgagcagctaggactacaggtgcgcactaccacacccagctcattttttttaaatatatattttcagtagagacgggatttcaccatattggccaggatggtcttgatctcctaacctcgtgatccacctgccttggcctcccaaagtgctgggattacaggtgtgagccactgcgcctggccaactgttaccactttctaatataaaacattttcgtcagcccaaaaaagaaaccccatactcattaggaatcactctcctttctccacgtccccaggccctactaatctactttctgtctgtattgattagactattctgaaaactttatgtaaatctcataatttaaaaaatttcataatttttaaatttttataagttgaaggtattaacaagttaataataaaatacttcttgagagctaactcagggttagctgctttatatttcttcatgctttagctcatataatcattataacagagaaggtagtttctattacaatctttctacagatgcaaatggaaaaactgaggcacacgagtttaagaaactcccagaactacacagttaaaaaatgtagaagtcaggattccaagtcgggcttttcagtcttcctgtgtttgccagctctcacctgagtattgtgttactagtagagggacgtgctcacagtcgcccctatgaggggtatttggatgcagataattaacatcatttcaatccacaaaaataggcttagtcctcaataagtaaggaatcaaggtgagggcactgcagagttagtattttgttgaagacaaattaataaatcttttttttttctttttgagacgagtcttgctctgtcacccaggctgcagtgcagtggctcaatctctgctcactgcaacctccgcctcccaggttcaagcgattctcctgcctcagcctcccgagtagctgggactacaggtgtgtgctactacacctggctaatttttttattttttagtagagacggggtttcaccgtgtcagccaggatggtctcgacatcctgaccttgtgatccacccgcctcagcctcccaaagtgctgggattacaggcgtgaaccaccgccgctggccaataaatcttaaaatattcttcctgctctcctttcttttgtctgttatttccctggatatctactgtgaaatactgtggtctcacatacaaaccaggaaaaatgagagggaggtgcattttatctcaaatacagaacttctaataaaacagagttattttaaatgtatagggggatcaaaatacataaacataaacacttgattatttgatttagcattacattcattgtattcattgcatgcattttattctgctggcaatcaaaattagttccagaagaaggtccggaatggcagttgacacattcccctgctcaatagccctgatatttataattatgatttgaatacattttactgggctagtaaatattaaagcaaatttttagaaatgatgaaaaaattaatttaagcattttttgtctctaaatttacaaacaacaaacatgcaattttctaagtagaataacacacaccagggagtaatgatatttgaaatgactgtgaattttggtctctggatgttcttggcttttggtcatatgattcactacaccttctaggcatgtaattatctcttaacacctcacatcctgtcatacagtatgccattccttaaatgagaattggtctcgagtatcattgtatatttagatcttaataattttaatagaaacatcaaccagtaatttctgaagggcaaaatatataaattttatcacttaaaatatatcttttctttaataaaatctagctcttaaaattctattcagacctagaatgatcctttaagatcatttaactcctataattaaattgcaaaatttgaaatatgttcaacttaaaattcaacctaaaactcaaagctgtattttaaagttcatgttgcacttgttttactgcatctgccagagaatgcaccacaaaatcctttatagatattcagatgaatctctctaccagaaatgaagaaggaacgctgctaatcttgggctttcattggtttgattaccatttcaactctaaatggctgcatgataattagtgggtgtggaataaccagtactgctcaagaagcaattgcctttactgaaaaacaaagtttcgaaagaagcacagtaaactccaagagacaatcaattcaatcttacacacctccctgccatagttttaaatggagcagatgtgctaaaagccagtgagaagacggttgatatttcttagggttcaaacagaaatagaatatccagcacttgactgcccatatttttcacaatgatttattgcagtaaatagtctacacgagcgtcccagttttggactttttccctatcagtcaggtttttaaagccttaaagtagagttaaattaaataaaagaagggatggcttttatctaaaagttagagaacgaacaagaatgttttctagatattaaagtaaattcatttataattatgccatattcagatggatgccattcctatatattaaatgttcatgattttaaaggtcattggacaaaaacactatgaataataaaaaattagaaaaaatgtgaaaaataatgaatggaattatagtagaatctattttaatggatctccatttaactgaatcattagattaaccaaagctctccattccctttgttagatttactatggatcaagatgacctgctgaaaaaccttaactagaaatctctctatgagagataaatcgtatgctttggcggattaaagatagctgcgaatttttttgacatttcttcactggggaggtaaagtctttgtttcctcccttgaatttgggtgggttctgtggctgctctaatagaatgcagtagaatagtggtccccagcctttttggcaccagagactggggtttgatggatgacaattttcccacagactggggttagtgggggggaggtgagggatagtgttaagataattggagactatttcatttatcatgcactttatttctattattattattacattgtattatataataaaataattatgtaactcaccatatcatagaatcagtgggagccctgagctttctttcctgcaactagacggtcccatctgggcatgacgggagacagtgacacatcatcagtcactagattgcctgatactcctcataaagagtatgcgacctagatctctcacatgtgcagttcacaatagggttgtgctcctgagactctaaagccattgctgatctgacaggaggcagggttcaggcagtaatgccagcaatgggaagtggctgtaaatacagatgaagcttcactggctcaccgctcgcctcctgctgtgcagctgggttcctcacaggccacagatgggtaccggtgtgtggcccaggggttggggacccctgcagtgaaagagctgctgttctagtttccagggttaggcctgaagataccagaaacttatattttccgtcttttgtatcattcactctagaaccctgagctcccatgtgataagttcaacaatcctgggtctaccatgctgaagaggccacatgtaggtactagagtcaatagatctagttgacccaagtctccctgtcgtctccaccaaagcaacatacatatgagtacagctgtcttggattctgctgaccagctcatctgccagctgagtatcatttagggatcaagttgataccacatagagtggaaaatcacccagttgacccacgctcaaatttatgacccacaaaatcatgagctataaaaagtgactggtgttttaagctattaagttttataataaattgttactcagcaatagataaccggaacatagcaagaatcaactgtgattgttcccattcctgctcatgtaatgatctaatataattatatactacataatttgatgatacatgactataaaataaagagatgcgttctttctaaaaaatacaaattatcagtaaaaattagctgaagaataaacaggcctttgggagagggatattagaaaagtattgaaggaatcccctcttaaattgttttgcaaatgtctctgtgttctttctctactgcacagaaacgaaaacgtacaagtctctaatctgtaccaccaaatcctcttgattttatgatctcttactactttcttccttataaaagtcagtcttttttttttttttttttttgagagggagtctcactctgttgcccaggctggagtgcagtggcgtgatctcggctcactgcaacctctgccttcagtttcaagggattctcctgcctcagcctcctgagtagctgggattacagatgtgcaccaccacgcccggctaatctttgtatgtttagtagagttggggtttcgccatactggccaggttggtctcgaactcctgacctcaagtgatccgcccgcctcggcctcccaaaaatgctgggattacaggtgggagccactgcgcctggccagtagtcacagtcttaattgctattccttgaacacactctcacctgagagccttttttccactcattcccttaacctggaacaatcttctctatctagttggcttcttgtctcgttctgatttaacctgctcagtgcaactcatcataacacattatttcatgctcttttccaggccctagtattcctgatttcccttgccctactacttttattttccttagcacttatatttcactaacacacaacataacttattaacctaccaaattactgtcctgattgtgggaaatcagagggcttttaccctgaagcaaaccacaacagagaaatagactattttgaagcaaaggtttaggagatcacatatagctgtgaacaaaatatcaacattttaaaactatataccagactattaagaagaactcaaggttttcaacaagggcagtgataaggagaggtcagcatgctttgctatgttatgctgccctctggcatggagttcaaataggccaagataaagccctgttcatgtatttttgaatggataaacaaagtccctctagatgagtacagcgtttgatttttaactacactatttcaggtaacccaaagcttttcttgtctgaaacatataagttatgacaggtctctggaacaagttatatctaaatgccagagtcaggtagtataaggcaaaaagtatacaatccatttttacttgtgtcaccaaacatctcttacattttagctgctgacttttcactaatgtattaatacagaatattatttctgcttttcttcaatttaactaaagaactgaatacttacatttagtatcaaatttctataatgtgtcttcttttaaaaatacaaaggtaattgaaaatatcaattaaatctgaatagtgactagattttatttagatatgagagatacataaatactatggatacaaatcatggtctctgccttcaggcagctgatggccctgtgaacttgtatgtgaagcctgtctggggtcaaattctagctctgccacttacttgtagtcttaggtaagttactcaattttttctgatctccaatttcattgcctataaaagagaattggtgtatatgccaatcatacctcaataaagcagtttaaaaaactgaagaatcaattatttctgaagaaaaaaaagaattggtaagaactcctttatagtgtgtgataattaaataacaaaaactagaacaaagtggcaggcatgggacatggtccatattcagagctaaaagttttctctcactatttttattttcctaaaatgaactagtatttctagaagatacaatgagaataaaaccaattgaaaatattttcttttaataacagtgctttaaaattagcaaaaaaattaaaatagaattttgaaaaaagtaatcaaatagatttgctgtactactgactgtatgttctttacatttgtatgttttgtttttatattttggtatttttaagtattattagtaggtgttcttaaacatttaggtaagatattgtatagttattagctttactattattattattattattattattattagatagagtctccctctgtcgcccaggatggagtgcagtggcccaatcttggctcactgcaacctctgcctcccaggttcaagtgattctcctgcctcagcctcccaggtagctgggattacagggacccaccaccaagactggctaatttttttttgtatttttagtagagaaggggtttcaccttgttggccaggctggtcttgaacccttcacctgaggtaatctgcctgccttggcctcccaaaatgctgggattacaagtgtgagccactgtacctggccagctttcctatttttctaatgagaaaatagtagcttgttgagagccacacacggagtttgtgatttttttttttcttcaggatacgttgcatttatattgtatatcagcgtgtattaaagtgtgtggaagccctctggagatttttacatgtggaatatactagttacttagtaattctctgtaggcaagcggctaagttcacgtatggaaaaccattaagacccattgctgtaacacagacaagggtattactgttaagtgtattgccattttatggtcattccaaacgagaaaagctgcttcattccaggaatcatattgctattataattcaccagaaaacctacactttcttttcctccaatagacagtcacttaaagcaaatgtacaaaaaaaatacaatggaatatggtttaggaattaatgaaaatttaaaaagcagcaatcccattgagaagacagaaggcaatacattttaaaaactgagcattatgcaagggaaaatttgagcagttttcaagttagttctgtattgttctcattaacaaatgtagatggtgcagcatttactacagacaattgattcagacttaaacttttgggctacaaatcatttatatttcagagaaaaaatatgtggtcaaaaacaactaggcagggggcgttggctcacgcctgtaatcccagaactttgggaggccgaggcaggcggatcacctaaggttgggagtttaagaccagcctgaccaacatggagaaaccccgtttctattaaaaatacaaagttagccgggcatggtagtgcattgcctataatcccagctacttgggaggctgaggcaggagaatcacttgaacccaggaggtggaggttgcggagagccgagatcgtgccattgcactccagcctgggcaacaagagtgaaactcggtctcaaaacaaacaaacaaacaaaacaaaacaaaactgtatttcccacaagagacattaaactatttttgtttttatttactaccttaatgttacgcaatttttcaaaagaaaatataatactgtagacgtaaaaaatttaaaacgtatgaaaactgggatatatcaattatcttaaagaagatattcctgaaacatacttaagatttaatattgaaatatataattgtttaaaaatacattaaatattgtttaaagaaattctgttaaaagctgtggggcacattatgaaggcaatactcacttctttacctttgttataaaattaattttgtccatcaatttttcatcaatcaaggtttatctatacacttgaaaattcaaatccacagggatcttgaaaagatagcatagatagtatctttctcttttaatagatgaaaaacaactgcagaaaggcacagacatcttcagtactaaataagtcatacgatacaatatgtctaattgatataaagaaaaggtaatcttgccatactgctccttctggctagtttatttctaaagctatatccaagaatcttgctaaaaatatcagctgtgttattttcattcaatctatttctttcaaacattctatttttcaaaattaggtttcatttgagcatcagtaactttagaagaaaaaataatacttaaaaaggccctggccaggcacggtggctcatgcctgtaatcccagcactttgggaggccgaggcaggcagatcatttgaggtcaggagatggagaccagcctgatcaacacagtgaaaccctgtctctactaaaaatacaaaaattagccaggcgtggtggtgggcgcctgtaatcccagctacttaggaggctgaggcaggagaattgcttgagcccaggaggcggaagttgcagtgagcagagactgcaccattgcactccagcctgggcagcaaaacgagcactaagaaaaaaattagtagtaatatgcaaagtcaggtctcagagctcctgtttcttctaaattaggtgtatctcctcagtctttgaatttagtctaaattggtttataaataataatcctgaatctttctagctccctgccacaaagatggatatttagatatactatggaatatttcactattcctgttttatttctagattaaaaatcaccaaaacaaggagacagaaattttatatcttccctgaccctaatttttccccttgaaatcttgctatcaattatactgacctttggttgtaggcatttctttatatttgtgtttttttgttgctttctacataaactctattcatggggtcttttgccaactcattatattatcctttcagaatatggtcaaaggcaagcccattttacaatccaattgtcatttctaagaggatattggaattactcatgtacagagtaaaaggttattttcctcacctcctacttagcaaaagaaagtgaaaacaatgacattcttatttttagtgatttaattacattttcttatccatgtgattttcttcatctaatttaacaaaattatcagagacatggtctgattacatatcatctttcttattccagaagtacaagacaaaactaaccttgatttctgcttataatcttacattctccccatggattcacacagctctaccctgatttgtggctaataacaacaattttaattttcctattcttttaatgaaagtaatattcctctcttcttctctgaaaaatgaatgcctttatgatttgggagggaaaaattctcctttggtgttttccttccccttcagttgacccacactattaataatcttcacaatatcaatcattgttgcagcttagacatagacaatgtttatgagcctttctctttttttttttttttagacagagtcttgctctgtcacccaggctggagtgcagtggctcaatctcagctcactgcaacctccgcctcccagattcaagcgattctcctgccttggcctcctgagtagctggaactacaggtgcccgccaccacacccagctaatttttgtatttttaatagagatggggtttcaccatgttggccaggctggtcttgaacccctgacctcaggtgatccacctgctttggcctcccaaagtgctgggattgcaggtttgaaccactgcacccagccagcatttcaaatccagatgctaccacaggaggctctgggccttaaagaaatgcagccagctagccgggcatggtggctcgtatctgtactcctagcattttggaaggccaaggtgggaagatcacttgaggcccagagtttgagaccagcctgggcaacacagggagatgccatctctacaaagaaaaaaaaaaaaattaaccaggcatgggctgaaacaggaggatcactttagcccaggagtttgaggcttcagtgagcagatcgcgccaccacgcttcagcccaagtgacagagcaagacctcatttctaaaaaataaataaatgaataagaaagaaatgcagccacttggaaccaatgctgtttttcagatctttgagcctctcagtaacattaattaagaaccctggtaaataaatatactaaccagtggcaagaataattgactgcaaatggctgaatgttttattattttcactttttttaaatagaagtttttgacaacataaaggccttacccaaaggaataacaataataatgaaaagagcaagcatccattgtgttcacaaaatcacagaatacatgtacatcaaatgaaaaataatcctttttcatctctgagaatactccaaaacttgtccatctgagtatcaatggaaaatcttgctctttattaaaaggaattcttcactaatgttcagaaaagctgaggaatgtacttacatcactaccgtcactactagagtatgcactggtggctaaaatgtcctaacaacttcttcagggctcaaatattttagggctttgaattcaaagatgtgtaaaatagagtctctgtcttcaaggactttataacttctatgcatatggtatgtgctagcgtggatgatggaagagttacatttaaccttcaccatggcaggaagatttattgggggagataaaactttgaagataagcaagagagccagattaaaaataaaacaaagtagaaggaggaaagaatgggtgtttcaagaaaaacaaatataatgtgctcttgctgatgggtaattctttgtgtattttcatactcctatttagtgtgtacctatttttctcacagtatatcgaaatacgctattatctgacttcctcgggtaagtctacaagaccaaatatacaataacaaatctattgagaagatacagttatttacatgcacagaaggttattgtgagaaactctatcaaatgcccttgctgatattggcctgacccacaattcaaacgtttgggtaccttcaagaaaatgtctgtattttttaatgtcctttgaaattattactctagtcatgcattatacgataaaagatacacgaaactgatgtccaatggaacagtaagctttgacagttcacattctttatagataataagatgtttaaattcatttccatgatgtattagtttcctgcggctgctgttaaaaagtactacaaactgggtagggtttgtagttgtttgtttgttttttaggagaaacatattgtctcccagttctggtggctagaagttcaaaatcaaagtattagcagggccatgctctcactgaatactctaggagagagtctgttccgtgcctctttcttagcttctggtattgccagcaatccttgccattctttggcttatagacacgtcactcgggatagcctctgtcatatgggattctccctgtgtgtcttctctgtatttcttctcttcttcttataaggacatcagccatgttagattaaaggcccaccccactccaatatgacatcatcttaactaattacatctgcaaagaccccatttgcaaacaaaaaccacatttttgaagttccagaaaagacatgaattttgagggtgcactatctaacccagtgcacgtgataacacaatcctcaatgaactgactgctgtcaatctctcagttttcaactccactactcaactactacatccaacttagcagacaaacaaatatatgtattgaatgagaaacagtccctagctggtaaaagtaaagtagggccaggagcggtggctcacgcctgtaatcccagcactttgggaggctgaggtgggtggatcacctgaggtcagggttggagaccacagccagggtaacatggcaaaaccccatctctactaaaaatacaaaaattagccaggcatggtggcacactcctgtaatcccagctaccctggaggctgaggcgggagaatcgcttaaacccaggaggtggaggttgcagtgagctgagatcgcaccattgcactccagcctgggagacaagagtgaaactccatctcaaaaaaagaaagtaaattagagagaagctaaagagtaaatcaggcaggattttctgggcagagaagtcatgcttggctataaagctatgaaagtacacagaaatcaaacatagctcatttagatcaggcataattattataataaaaagtcattatcttatggcctcacataatattattgcctatatatttctgtgttggtccttcataatacttggatttacatgcagaattgtatatttctgtatcatattttaagtgctctgtaatgcattaattatttgctagcctcatgtaggctgcagctctccagcctttaagttcagtcatatgccaacctgaagaacgtgagggattgagagagtgtcttaaatgagagaagcccatggtggccagcttcatcagaaacctagtgtggctctggttttcgccaggttctttgttccttgtgactcattctctgccttgcattgtctattcggtcccctcaggcctgtcctagctggaaagagctctctttacttcctgatcccatctgttccttgacctcccctctgacccaccactgggcatgctcagaataggaaattgtgccataatagataatcctgacactctgttccatttcttcatgttagttaattaccattcaaggtcttgaggcctacattaactgctcttaaatgtcaggtctatgtacctattgcctgttatggagcaggcctgttggtgaccaaagcagcataacctagcatctgttgctcagatatcatgtcccagcaccccaattaattgccctagccctagtctagccagtcttcagaactgaatcattatttatttggtctgtatgcaaaccaaaccccatttaaatcacattcatctacccaggactctcatttatcaatcaaactgacattttaaatgtcagatgagttatggtatatcctttgagtgatcatgataacattccctcatatttaggagataaactgtctgcatacatcaatatttttaaacaccgaagtaagtgtcaaaggtctgaaaattaatgatgaaatttatcacttcagtattctgcatgcttaaaagataggagtcacacctaccttccaataacctattataagagccaaaaatgatagctaacattcaaaactaggtatctatcatacaacaaatattttacaaatatgttctcatataatattcatatcactgttattttcccacttcatagacacgggcttagtgaaatttcataactttttcaacattacaatgaaaaatatctgagtttctttagtggctttgcctgttgcagacctcaattttttttttattatactttaaattctgggatacatgtgcagaacatgcaggtttgttacataggtatacacatgccatggtggcttgctgcacccatcaactcatcatctacattaggtatttctcctaatgctatccctcccatagcccctcacccaccaacaggccccagtgtgtgatgttctcctccctgtgtccatgtgttctcattgttcaactcccacttatgagtgagaacatgcggtgtttgttttcctgttcctgtgttagtctgatgagaatgatggtttccagcttcatccattttcctgcaaaggacacgaacacatcttttttaatgtctgtgtagtattccatggtgtatatgtgccacattttctttatccagtctatcactgatgggcatttgggttggttctaagtctttgctcttgggaatagtgctgcaataaacatacgtgtacatgtgtctttatagtagaatgatttataatcctttgagtatacacccagtaatgggattgctgggtcaaatggtatttctggttctagatccttgaggaattgcatacctcaatttttaaatacaatttaaaaatacaatcaattttttatctatatcacattcaggcctacctctaaagtatataatgacaatccccgatttacaatggttccacttacaattttttgactttgcaatggtatgaaatagtgcacattcagtagaaaccacacttcaagtatccatacaaccattctggttttcactttaagtacagtactgaataaaagatactcaacactttattataaaatagaatttgagttagataattttgcccaaatataggctaatctcagtgttctgagcatgattaaggtaggctagtctaagctatgatgtttggtagattaggtatattaaatgcattttccacttataatattttcaaattatggtgggtttattggaacataaccccactgtaagtcgagggatatcagcaacgcgtttaggaaaaatagaggcaaagtgtcctctagggtggactcagctaccagggccacagcctagtcagggacactgcctttatgtgaaggaaggctctacttcctcagggcagacacaatcccatgagtgtgtcttggatgcctttacaaagggctggatttcagtcctcacctgccttctcagccgagcatgcctgggcatgcaaaaatagcacaatggtacatggaacccttaaatacattccattaaaacaaatacataaatttggcagggcaaagttaagtttagaaatctattattcaaaagccagcaaggattctaaagtccttcagtgatcttagattgcgatcttttgaagaagacattaaatatgataccaatatctgacctcatttatcaagaggaaatgtgagtttctctcaaagggtgttgagtagatatcacgtgtttactatctctaacaaacagaactcatccagatgataatcttggtcttgcctgccggtgatgatctagtaaacttatagacacagcaattttttagcaaactttaagatagtataacaaaatttaaagacaaaactaaggatttttaaacctttaatcttatttaaattagaactctatcaatgaattaaatgtccaacctaggtgttaaaaattctctattactctaataatttctccccaaattttgtaacatattcgatattccagaactctttgcattgtaatagcattttgttgcatatgaaatacgtcacgtatctcattaaatactaaagcaaaacattaaaggaaaaattactgtcccaatcctacagatgaggaaattgagtctcagtatagttagatcatctttctaagggaaacacaagacttttgtctttatcaattagtcacatcatttatatcatttattgagcactgttctaagggtatcacaaatggcggctgctctttgaatcatcaacagtccaacaaggtgtaggtgctgttattttccccatgtttacagaagaggtagattgaggaacagagaggttaaataatgtgcccaaggtcaaatgctggtagagaataaaaccattttttatgtatgagtgcctatttcttacaaaactctttatatatattatgttcagtattttaggaaccagaaagggtgatattgttattcccattttattattgataaatctgaggttgagaaaggttaaacaacacaaccaaatttacgtgactaatgagtgacaaccaggaatcgagcccaccttttgctgtttctgaaacatgtattcttcccagaataacctttaatctctcaataacagctcatacaattcctccttcccatctcacaaaacctattctgagctctatgtctaccacgaataagcccaagagtagagagaatttatctcacaaggcttaccgtataccccttttcaataatttttatcacattatttctctttctcttccttagtcaacaacatttaatttactcctgaaactatccctacactaatctgaagttgttaaattactaagttattttgcattcatatttccaaaattaattgtccaagttcatctctcaaaatgaaataatttcagctagaaatgagctgtggcacagtaagcctttggatggggaaggtaattataattgttctgtaactctggttatggaacatgatctggacagtgagagttggatagagagggaagccactgggggtagtgtgactaagacactgttttagaatctgaggatatgagttcaagttccacagctaacacctgctagatttgtagtctgtaagttgtcaaatttcaaagaatcttatattcctcttggataagagataggtaataaaaactacctggcacagatggttttgtagaaaatccaataaaataactgtggaaactttgaaattttcaagtgccattaaaatatcaaataccaatttaataattagcttatgatcagatggttagggacgttgactgccgaagtgtatattcaaatcaatgcagtataggctttaaagtagggccaaagcatgaaatgcattttaataagtgtacacttctaggattctttgaaagttgaaaaaataattagtaagaaaatggagatgaagccctacactaggatgatagcacttagaaaaagataaaagtgaatagatgtgtcaaaagcagatttaatgggaattgacaaaaagggacgaatacttgaaactgactcaaagattttgagtctgagggattggaagagtcaggggactgctgttggaagagtgggagcaaatagaatcagaaaacacacgcacacaccaaaaataactggttttggatattttgagagccatagcccaaaagctaaaggctgttctatgttgaattatcaaagccactttctgatctctgtttttatgctgtttttttttttagcattttcaaatttttcctcacttaagattctgtaaaatttttattgcttatatgcttgtgtaagaaattcatatcatgtgattgtgctccaaaaatttttagtaggataatagcattttactgcttctgaaaatgacctgcaatattaggttattatttgttatattaggtctagaaacagcataaactattgactgaagtttgacattttaaaattctctaataaactggaggaaagtccacctctgctggaactctgcagtgcacagaaggcaaataatagactgctatcctgccatggcttcgcttaatacaaatttgtacaatatatacaatttaaaaatgaattcataacatttctattttctcataaaacattgtgatatgtcaggccagtaacaggtgtgaaaatgatggaatcaaatcctcacagaatacgtgtttagaacagacctcttcagtaaagacaacttttaaaaatacaggccgggcacgatggctcaagtctgtaatcccagcactttgcgaggccgaggcaggtggatcacccgagatcaggagttcgagaccagcctggccaacatggtgaaactccttcactactaaaaatacaaaattagccaggcatggtggcacacgactgtagtcccaggtacctgggaggctgaagcaggagaatcgctagaacccaggaggcggaggttgcagtgagccaagatcgtgccacggcactccagcctgggcaacagagtgagactccatctcaaaaatatatatgtgtgtatatatatatatatatatatatgtatatgtgtatatatctatatctatatatatctatatctatctctatctatctatctatctatctatctatctatctatctatataaagttttaggagaaatctgctcagaattgcattcctctcttactcatagtgataaggggacctcgtagctaaaaagtcttgtagaggaggttaaaagttcttcaaagtaaaaacattctcaactccagaaaacaacatgtaagtcaacccactcatgttttctaagccaatatcttagaaagttgttgtcgactcctcatgagcctctgctacccacagccaatctgttgctaaatgttgtgaattcttttttattgtattgtatgtcttaataacttttttcttcacttgccaaaataaaatccatatgctccccccaccctactgcatggttctccagtaaagactatagatattttttctgcttatttatatatattaaatagatttttaggcagtaatttgaaaatcactttgtctctttgaagttgcaaattgttatagaccaaggctggttcatgcccataaaggttgtttaattaatcgaatttgatatgacagagtattacacacaaaatagtggacggaatatgcacaaaacaagtttttcacaaaaggaagtgaaaagcttgtgccaaattcatctgtgtaacactagaaataaatattttaaaaatatatttattgcttagtttaaaaaactggccatttctgagctttaagctatcattggaagctttataatttaaggttttatttgcttgctaaatataattgagctgtttaattgtaatccttagccttggctccttagccaatgtagagcttaataaattcacctttagattatcaataataaacacacatggtaaaatctaatattgcaatagtccgtaaacttccgggcttactttctaaaagcagataagcagagttattgaagaagaatcgtgtgtctatatttcagaggcataaactcattttaggagtcattattactacactactttcacagcatacctttaatcaagtatcagaaataaagtagaacacatcagaaaataagtggtctgataaacaatttaccacacctgaaatgcagactttcatacgaaaaatgttctagcacaacagggtccacaggcaatcaacaatcctgttctcttccttctcctgggctgatctattagcatggctaatagatcattgcactctcctacagaggccagatgggacttctccacattttagttcaagaagatactaccaattaattagagttggcacttgaggttattatttgctttgctttacttactttctttctttttttttttttttgcatacagacttagacagctaaattaaaatcatattgaacatctccttcaatgtgatattaggacatttctagaagtgtttacttgaatctacagattttgagctataagggacttgagtttaggaatttagtttaaatttgactaatagcatacagttttctacctcagcctaataaactcactgactctaataacgaatttgaaaaacaacatgtccttagcatcctgacaaacccacagaactgctgctccttcctcctacatgtcagtttgggtttcagcattgcatgacaaaaatctcaattttctttatgtgttagaagttcataattggaagtgtgaataaaagttaggggaaaaatgacttaaacttcagcagcaggaaaagataatctttactgtctgtctagttttagagcatccaataaacaagaacatccatcaaaaaactctttggtggcttgaggaaatgtggggagtgcctgagtatcacgctatccttcttgtgaaatttttgataatacatgtctgtagtaagcatgattcacaactactaactaaacaatttataattccaacaatttcacctaaattacacaaaggtgtgtttagaatatacaggagaatagccagtatgaaaaaaaaatgtattcagagaaaagacaaataatacagctcaggaatgaaatgtttctcagctaagggacgacataggatcacaattcatctaggtgttttttccgcagttgctttcagtacatatttatacaaacagaataaaagaagtaccggaaccaaataagtagtaaacaaagggggaaagagatgattttgtaatttgcaatgctcatgcacagaaaataaaatgaaggtaataatagcacaaaaagaaaacaagggcatcaagtaagaagaggaagaaaaccaaaacacacaggacaagaagatggggcgttaaaacaagaaagctctagtggagcagtaactgagggtaaaggaagcgctcaagttttgatgtataggaagcaaagaaggtaactgaaagtgattaatgatgttgttttggcaacagaatagcagattaagggcagctttctgaactgattggaaaggatgctgaaggaaggaaaggtgctcagtgtgggaaatcggagatggcaggatacaggaataccaggtcaagagagatctcagtagtatattctaggttttaaaaatataatggagtgattgatatagtttgaatagtagtctaggtgttagaaagagacacagctcaacaatatcattatcaatcatcgctgagaaaaggcaaggagtaatttaacaggaatgataagcttacaggaaattaaaagtgaaataagatatatgagaagatgtgagaaagagattaacaggattattctttaaaacatggaagtaaatttgagaaacatttccctttccaaataataacccatactcctaaattaaaacttatggtgaaataatacagcataattttctacatacggatgaattcagtaaggagaaatacttaatttctaaaaattgaaagcgcaaagttattttgatttgtaaagttttcagatcattcctctattaaatatcagtgactttgcttactactttttcaggtattgtggggtatgtatccaaaaaagtgtgttacctgatttatgcatttatgtctattttttaaaacattgcttcttctataatttctcctcttttcagttcaaagaatggaatatagtacaaagaaccttgaacaaaaagtcatggctgggctttatttctgaatatacatacatacatatatatatatatattttttttcctcagtgtgtattcattgagtgaacctgaatgagcaatttaaactgtctaggctgccttttactagtctatcaaataaaagaattaatttctactcaaataaatctagaaggctattaatgggatattaacacatttaaaagtggtttaaagtagaaaaagcaccatcgatatgtatcactgatttgcttatccattccacaaattaagtacctactatggagcagatgctgtcttggttctgggacaacatctatgaatgacactgaaattgtccctgctctcctatcaggtattggtattattaaaaactgacgtatttctgagaagtcctgagaattctttctgtagtaggaaacaacgcttgaataatttctgctgaagaacatttaaaaacacagttatgaaagctggagagtaatccatattattgtccttgcttcagtttatttttctattattattttatgcattttaatgtaggtaaactaacttcgatttaggtctttctccttgcacaacttcagggaggactgttcatagaaaatataacttgaaaattgtgtccttgaatttatgcactaaatggtactgcttcaattcatattcttcaattcgactagtaattatttgaaagatttttaactttataatttgaaagaaattagacttatatgaaagttgtaaaaattgaatcacatattctaatgtatccttcacccagaatttttttttactttatcttaaatataatttctttttgtctgtattttagagtcaatttctactcagaagaacaagtatataatgaaaaactgttaaaatgtgtgtggcacagaaaaatgattttgagagtaaaatttgagcatggaaaagaagatgacttaattattatacttatattcaagcacaggggaccaaaacttttctcagcaatatcatgtctagtaagagcagaggaaaatatttaaaagcttggacttgggaacaaaatggcccagagtcacttcccatttaccacttatgaatggtgtggccttcagcatgctcattaaccattcagtgtcttaaattccttttgtgtaaagagagaatattatcatatatcatttaaaggctttataaagattaaatgagttaatatttataaagtgcttagaaaaaatgtctggcacacagtaagcaccattaatggcttgataaaagtaatttgacaggtaaaccaacagtactctttctattttgtaatgtcaaatcatggctacacttgaactctgagataaagagaaagattgggggcatggaagagtagcgtgtgtgcatgtgtgtgtgtgtttgtgtgtgtatatatttaggtgttaaaatattttatctaagtttccggaattctgcacaatgtagtgaaaataaattggtaaaatcacgtttatggctaatggcaaacatatatacaatgtggcaattactacttccaaaatactgttgaacaaaaaataactttatttactatatattttttaacatcagaaagaacgttgggatcctacaatcctgccaaatcttgattttgacctgtatggtactgggattgtagtgggctcaggtgttttgttgacctttgaattattagccatactctgaaagttgtttttgaaattgaatcctagaaaattcctgatatatagcttttttttttggaaacttgcattcagataatttgggtcttaaggtaaatttaaattaaccctatttagaaacgtcaaggaaattaaacatattaaagagatattggtgtcacatatacaaacttacatgagccttctttaggaagaagcaagcagataaatgaaaattagaaaaatattgaattgtggaaaacagaagtcaatgaggaaaaattagtaattaatccaatgtagtactctgagatcattgatgatgccttgagtgtggctgggagtctacctggattattgatggggagaaacttttgatgatcatggtgacaaaatcaaagagaaggcgtaaaggatacagttatattccctaagtaaaataattagttataggattgagaatttcaaataaaaagcaatatggaaaagcatttattatataaataatgtaactggcacagaacacagaaatgcatgaataccttttgaatttccaaataagatagattcctgtcaactctctagaagataggtttttttttttgcctctattgattctcttgcatgcacaaagtctttgaatatttgtttctcatcagatttaccttcaacagtattggggcctcccaattacatacatgcttttattacccaatgaacagaaaaaaaacaattactgttcatattatttcaactgaaatcaagcttgttaaaagctctctcacaattgttaattttgtacatttgcaaaaatcaatagctagaaaatttactagacacgaaggcctctgaaacaatacaaatgatctttatgccctagggctacgaatttattgataaggttaacaatccttgggtaatgacagcttacttctcttctgaatctagcctaaagattccattaaatatatttctaaacaacaaaaatgtctagatgagagtctaaactgatttcaagtgtttgcttcaaaggacaaaacaaagacagatgctcccttccagccaatgacttagacaatccatattaaagattgaagtcaatggtcatgatatactaggttgggcaatctggcttgaatgtgacattgactggtttaaattttgaattaatgttctctcaaaatatttcatccatcagttggtttatttacacttattatttaccaattactgacataggtgctaacacgcagcaaaaacttttaaaattatttttatttgtatttcctttttaattttaatagctttaggggtggaagtggttttttgttacacaaatgagttctatagtggtgaattctgagattttagtgcacctgtcacctgagtagggtatattgtacctaatgtgtccttttttttaatcgctagcccccctcctagaactcttgatgaattcagaatctagggagaaagtcagaaaagcaatcagtcaatacaacgtagtacagaggaaaatctctgaatagacttccatgtaaccaatgcctactcaggtaatttgccagattaacaaacaccctgcatttcctctgaaaagtacattggctaatgcccagggcaagatggatacttttaggtaatactcaactcattggtagacccatgaggttccgctctcacaagttgagtatgtacccaaaagctaacttagttaagccagttataattatttctagagttacataaagattatcaactgaaaaatgtaagctccatgaagacgagggctttgccgttcccaagtaactagactagatcctgcttaatatttattaagtcatacacttacaaaagtttttatttatgcaaaatctaaactgaatgttgtagaaataatcaataaatatggttgcaaaatgattcaaatgcttggacagacaaatgtaaaattttattaaaaataataaaaatctttagttctatgtgcagattgcttcacaaatatcttttatttctcattcagatataaagaaactgaaactggaaattatagattatgctagctatgagcaatagaactatgatccaagccacataggtaattttaatttgtctgatacccacattacaaataatgagaaatgggtaaaactaacatccatactgtattttacttaaccaaacagatcccaaatactatcatttcaagatgcaacgcatataaaattattattgagatctttcatattatttttacactaagtcttcaaagtccagtgtgtattttacatttatagtacctctcaattcatgctagctacattccaatggccatagatggcaagtggctaccatactgaacttcacagaagtagacaatatggatgtgatttctgtaagaaagagaaaaataatctcactctaatctgtgaatttctgtagtaggtatgaggtctaggtctatgtacattttgtttgtccgtggatgtcccattgatccagcaccatttgttgaaaacactactcttcctccactgaatttattttgaaactttgtcaaaaatatgttgggcatatttgtgtgggtatgtttctagactctttattctgttcaattgatctatgtgtcaatccttctgacaatataacacaatatttgttgctgtggttatgtggtaagttttaaaatcagatcttattgtataagcttaacaacatataatgttactgaaatgataacttccgcaatttggggaaaaaacagaccagatggattgaacactcctttaaactctctctctctctctcagctgtctaaatgcctcaaaatggaaattcaacagatgagagcttcttattgagaaaggggaagtagtaggggaatctattttgaccacctctctggtttgaaacctctgggggtttaagagaaaaggagattcaagatatggcttagttttaatgttaatgctacagtagtacagctgggacttgtcctacatttactgagaactctaatttacgaaaactagatcctagcattctgaaagcagatttgagacctctaaagctatttcttttacagttttttccacctttggttgcagtctattgtattgtcctgattctttttttcacctactcgtaggttattcttaatcacttgaaaccaaccacttctatgtatatgatttttgcttcctttccctcacagatccctcaggtaccctgtcttatacttttagtaagtcatgcaaaataattgagaaatgagtcatgcaatttattgctgcattttattaaattagagtggtcagatatacttttactgacagagatttggattttactgtcttgaaacagaagagagagcaaaatggttaagaaggtgatgagaaaatgaactgacatttatgtaacagtgccttattattaatatatggttggtgctgtgctttgtaccctttgagagatattttgtgatccaattttatagataggaaaaggatctctaaatattcagttttggaactgatgttctaaccaggtcatcctgacttgaaatttcaggtgattccctcatgatgcatcttgacgcaaacaaaaaatgtactgaatatattattataaatgtgagtaactagaaatgcatgggaaagaagaggggaggaaaagagtaaaaaggaatattaaacaaatgtattcaacaaacctttattgagtgtctattatatggctggctatgttctaggtactggaggtgtggtaacttgggaaaattttatcaacatatattacagtattttctgcataattccccgccatacttttatttcctttgaattcacagtttccattaaaataatttattgagttaaagcctagagcatagacaggcaacttttcaaagataccataataagtttttatttactcatttttgaaagaaggactagtcggatgctggccataaacaggggctaaaatttcatccatctttccatttccaccaatggaggtgtagagttggaatgaagttaagtgaccaagcctcttgagagaggtgaaggatatctcaggaataagcaactagcaatagacaaaggagaaaaatcgaaacagagagaaagaatggtttggtgctgtccattccccatccaccactgccaaacatacttatacaactctggccactcaaactacctaaatgagccaacttcgatgaaacaaacactattgggagagattacactcccgtggtagtatcaagtaagatcttatcctgcatttaacgcattaggaggaagtatttcaccagtagctaaaaacattattagtctaacattaactgtttctatcaaagggatttaattacatgacattaaatagtacatgcacttgtatacaaataatttttttctcaacaaacacagaaataataaaatagagaaaagactaggtgacagatcacatatattgagatacttgccataaggtgagactgatcaacatccttcttcaaggatataaaaatttaatttacttagagggggtttcagaaattactaattgaaagatcttacttaacaaattttttttacattagaaaaaatcagaacttggtaaatcctcttgtcactattagtaaaatcatgttaattagtccaaaactttattttaatacactatacttttcctatacttcagtcaataacttagtttgtggttttctataattcaatcactaagtttatttagagaaaaatatccttaacttggagtccagtggtctttgaatctcccaaaatatatgcaatattttatgtccatgtgtgtacatcatgagtatagattctgtgtttacatttgatttttaaaaagatgcatgtttaccctccaactaaaatcatgaatttattgttttaaatttaaaagttggctaaatggctatgatgtttatgtattttcatcaaaagggtagttgtttgtgttttatttccaagtctatgacttgatgtacaaaaacctttacactgtatcgtaccccaaaaacatactcagattcaaaagagagaggaattagaaaaataatgaaacatttcagtttaaagtgtcttctcagtggcagattcagtgtattcattacttttgcttcttctagagattaaagtgcataatctaatctcataaacagtagctaattcatactggcttaatagaagatcagttgggaataataagctcgatagaatgataacattattactggaattctcagaagaacttggcaatccaagcaagatggataagactaataaaatattacaaagaataaagaaaaagttaagatttatgatagtctatttatgtttctgttattatgtcatataataccataagctgaggtaattcatatagtctgttctacatttcaccaaatcacccttaataactaaacgataaagtgataaaattcaagacactgtgttggaaaataagagggcagagggaaaggagcttggatgataaataataattaactccaatttctaaggaccttaaaatctggttgtcaataaacatcaatacacataaaaattattgtatctatataagattggtaactacaaaaaaaaaaaaaaaaaaaagaatccccagaatccccagaccctgcagaattgggattgagggtagaatgacaagggtcctcacagctgacaatcatgggaacgacaaggagaacaaaagacatttcacacttctcaaagagattactacctgttttgaggatcacttgtcaggagtgcatcttctgtgactatgcagggtggtcaggtaaaaggaagttactacagtaaaggatggtgatgaggaatggtgagtttccaggtcactggaaactgaaagtctcctatgaactcgagaagccgcaaaaccaaggaagagaaagagtaattttataataaatgttgctgtggatttcttcatatctgttttaacacttttgagttatttaagtgtgtgactacttaattaatttttgttattgttgttttgaatgtggcatctacccaaaattggactgcattggtctctgtatttacaaggcttatatttgcatatattaacttaatgcaatacataacaaccagatgaacaatccagatataggggaaagtgattacaccttgtactgggatggacaaggaggacttaattaaggaatttagagaagctcagtcatgaaattagggtaaacttcaaacaagaaaaaaataaaaaaggatgggttgaaactagggtaggattgaaataagaaggaaatagatgaacattagagataatcacttaagtgaaaacataaaattgagaatgccttatcatgaaattcatgcatgaaattctgtcatgcctgttgatctgtttaaaaaataatagtagccacaaatattctcaaatgatcatgcatcgaatcttgtggaccccaagagtaatcatatccctaagggagctaaataacgtatgagtgtagatgtctattgcaatgcagtttttcaaaatgccattgacaatttgttgacttccttcaaggttggcttagctttctttctcagcctccaaaaggctatcaagtttcccatgtagttctttgagatgatcgatctatgttttgggaggagttgcaaaatatatgagatatagccaccttctgtatcagaaggattccctcttgggttatcagaacaatcaaagaagctatctgattactggaggagagactgacataaaattgtagtttttaacttcttgtgaaagttgtgagagcttgacactgcatgcaggagtaacttaagaacaatcttccctctgtggctttgaaatcaccccatgtgggataactacaaggcctgttattgttggaagagctaagcaatagtttaaagagaactagatttgttacaaaaatcaagatggctgcctaaaattcaacatactaggcctatttacgtatattatgcccaaggcacttggctggtaatacaggggctaaacaaagaaagaaaattagttcttgcctagggaaggaggaaaaggaataatttattgagtaccaattatacactatgccctttatatttatgtcatccaatgcacaaagctttattatgatttaggaaatattatactcactttacaggaaaaaagcaccatgaagtgaaaagaacattgactacagagtcagacacacctgagtttgaagtgtggcttagcctcttaatagttctaagaaaggaatttaacctcttcgaggccagttttctgattagtaaaacagggaagcatattaccttctattgtgaaggagcaaataccggctatgctgttttgcagttaacattcatatgaaaggtataagataataataagtaaaatgtattattttattaaatgtatatcatgttccagaccttattatatgctaagacttttccatatattatctcatttaatcttcatagcaaccaggtgaggaggggccaggaatttttccattattttacagttaaggaaactaaagctcagatttaaagaaacctgggtgcagtcaaatcaaaaaagattaagtggctgaaccggcatgagctatatcgtgctctcatctcagagagcctttcgcatagacatctgaggaggaacaaagggtaacaataacagctctttctctgaccctcctgattttcaagccagccccttccacatgcccacttcaacccttgccaagattcttgtgtatgagtaactctgttacctagtctagttttgcatgaatccctgttcctcttcaagcacttctttagcttcaggttttctaatctggaaacttctgtttctgaattagacctgaactaatttaggctgtcaaaaggtttgtgtcttgaaacttcccctgagtcggaacaataaatattgtgcataaatagaaactcagctgaaataaggagaagagttaatgtaaaaaaaaaaaaaaccaggtatacgtataattatattgtcaactaaaaaataaaatgaaataaaagcttcggcttcatacgtggattcagggattcacaagagagcaggtttgcagccacgaaaaagcaagcacagaagtgtgtgtgtgtgtgtgtgtgtgtgcgctcatgtgcacactcaagctgttgatggaacatagcatttgtgagtgaagggatgaaaattagaataggccaggcgcagtggctcacgcctgtaatcccagcactttgggaagccaaggcgggtggatcatttgacgtcaggagttcaagaccagccttgccaacatggtgaaaccccatctctactaaaaatacaaaaattagccggtcatggtggcgctccacttgtaatcccagctactcgggaggctgaggcaggacaattgcttgaatccagcaggcggaggttgcagtgagccgagatcatgccattgcactgcggcctgggctacaagagcaaaactgtgtctcaaaaaataaaataaaaagagaaagtgctcaaaagagaaactgtgtgaaggggacagtttagggcttggggaaaacaaaacaagaatgcgatctcacctagagaccaatttccacatgatcccacagggagctctggagggcaaattgcatcccagagctgatctcaccttgtggcaaatgggttggactcttgtactttcagtcgttggttgcaaactgacctgaggtggggcacatatggcctttcaggctcctggctttcttcagggtaagaacaagtctctggagaaggaagcagctgtgggcaacaagcactcccagcagctaggggatgggtgtgctacctggtgatggggacttcagtagaacatatcagtgcccactagagtcagagagaattgatttgggtcttaaagacagtatacaaacggaaattttattttattttgttttatttatttttttgagacagggtctcactctgtcactcaggctggagtgcagtggtgcaatctcggctcactgcaactgccgcctccctggttcaagtggttgtcctgcctcagcctccctagtagctgggattacaggtgcgcaccaccatgcccgactaattttttgtatttttagtagagacggggtttcaccatgttggccaggttggtctcgaactcctggcctcaaatgatccacccgcctcagactcccaaagtcctgggattacaggcgtgagccaccgcgcccgaccttattttattttattataataagaagacaacataagatctactctcttaacaaatgtttaagtatacaatacggtattgttaactacaggcacactgttgtgcaacagatatccagaacctactcattttttataactgaaacttgatatctgttgacaacgggaaatattttctttagtctcatgatattaaaaatgtatctgaatttatgatttttagataaagcactcatagagactattgggcaaaatacgaacagatgtattgatttctccaagggttccaaactggaattttaaaaaacttgagttaagattcatgcatatttagtaacaacctagtaacacggatgtatgccctcagagaatgggaatcagaatctaaagtattgtcactagagattgaaacaaagctttcaactccaattgttataaaagaaggaattagactattttgacataatccactgcaagggaaagtaagcagaaatatccagtgggatttggaggaaagctgtgtaaagggcgcttcttaaattggacaaaccctttcactctgctggagtccttcctgacacctggaaagaggctggaggtccagcagccattttagacaatgatgttacatcgaagaccgaaagttgcacagaaagatggaaggttcctgggtccttgaccaccatggccctgctctaccggcaatgtactgcttccagctggagctcactcatgtggcaaggcaacaaatctctcttacttaacacacttctatttctggatttctgatacacgcagccaaacccaatcctacctgatgcactcattttttaatactcaaaatgggaactatcttaccattatcactttttgttacacctcagattttcctgaaaaagtgcattgtcaaaacatatcattatttttaaaacaaagagtgtataaatgtattattaaatacattaaaaccagacaaaggctcataaattaatgcaaacgtgtggaatagtttcatcacacaagtgaaaattaaattggactgctctgccataataaagctctgtttgcctgctttgaaatgaaaagcatcatgcaacttttactgctgcgtttctttgaaaagtaccaaatctctcttctgagttgctcttgtctttttgagtataaggtatttattaccactgggataaaaacagaatgttgatggtcacatgatgcaggcagctgggatttcaactcaaggtcagtcactggaccctcaggcagccagatagtgttgtttattttttgccaaattgatgatgcctttagcctttaaataaggagcactgactatgattaaattttgtcctaaagagatatttcacactctaatacatagaatgtatctcattaaaattgtaacagagtaagaaaagcttacttcagagatctctcagaaaaaaattggagtacagcctgaagttatctaaaataatcagcatggaaccatgcagatttgaaatcagatgacaaacatgtactttcaaagcatgaacatttgaaaacagtaacttgcatcagtttctaaacgagggatttaatgtaactatcagaataatcagtgtgagatactgaaatataaaattgaatttgggtcttcagaattagaaacttaacagaaaaaggaggtcattgtagaaatgttacgaaataattttgtttttatgcctaatttagaaattgaatgggccgggtgcgatggctcaccactgtaatctcagcactttgggaggccgaggcgggcggatcacgaggtcaggagatcgagaccatcctggctaacgcagtgaaaccccgtttctactaaaaatacaaaaaaattagccgggcgtggtggcgggcgcctgtagtcccagctactcgggagcctgaggcaggagaatggcgtgaacctgggaggcggagcttgcagtgagccgagatcgcgccactgcactctagcctgggtgacagagcgagactccgtctcaaaaaaaaaaaaagaaagaaaagaaattgaatgaaagttcattgataatgcagagattctaaaataaatgtagccaaaaataaagccaatcagcataccaaaactattacaatcttagaaatccattatgatttttaaaaagtgctttttttttttttttcctctgagatggagtttcgctcttgtcgcccaggctggagggcaatggcacgatctcacctcaacctccgtctccagggttcaagcaattctcctgcctcagcttcctgagtagctgggattacaggtgtgcaccaccacgcctggctaattttgtatttttagtagagatggggtttcaccatgttggtcaggctggtctcaaactcctgatctgaagtgatctgcccaccttggcctcccaaagtgctgggattacaggcgtgagccactgagcccggccgaaaagtgctatattgctattccctactatttattattctgaaagagacatatcacatgtttaaacatttaaataacgaacaaacctcctgggatcatcatatttatcacgcactttttaaagaaaatcaaacatgcttctgtttatacaaatttattcccattctaaatatttattttacaaacagaatactttcttatattcttgggctacatgaatcattattatcaacagaagggtgtctgtcattacaggaagcacaatacttgtatacttttgagggttactcacacacacgcgcacacacacatgcacacacatacacacagagtttgggacctacaagactttataatcttattatgcctgctacccatttcatcttcttcttcactgtttgtcttgttgtatctctgttcgttgtggcctacccacccctgctcctctctgacagttttgggttgaacttacctggctctggttccaggagtgggtgtctgatggaacctgcccaatcagaacactgtactcctgaactaggttgattgattcaggaatgtgtaggtgatttcttcagagtcaattacaagtaatcctaggtcttctgttggagagaatggtgttttcattttctattggaattgaggtacaatgatataagtctaagactaataatgggtcccatatcgagagataatgtctaagagctttttttttttttttttttaagagcctttgaaaacacagtggagaaagggtgagagaggtactgggctaggtgacatcacttgagatcccaaaactaactgtatctgaagtaagtaatacctcttcactttttcgttacatgagcaaaggaaacttttttttttcttaaactggtttgctaggtttttgtaaattagcagaaatggtgcttacatacacacatatatgtatgtatgtatattttggttgagattaagaaatagagacctaggttctaatgatataactgactaaagataaaattaatccaattattgaaagtttcagcacctcagttgcctctttaaacaatgagttagttagattacatgactgacagttgtctagatctaaaatcattggatccaatcaattgattttcatgaatgaacaaagacatttaaatctggaagtaagttctattaaacctagtatcttgataaccccaggccagataaaactataaaaaaaaaatgactggtctctatatcagtcgatgggcaccattttatagttaatttatttcaggaacatggcagttataacacaggtaactataggacaagctggtaaacctcattgtaggtaatcactgagctcagggaggtagcatgatgtggtggataacagcaagggatagggaaggagaaagtttgactttcaaagtctaattctaactcagaattcttcatctgtaaaatgggaacaataatagctctctcacaggcttgtcctaagtatttactcacataatatacacaaagctcttattacagtacgtagcacaaagtaagtactcaaaatttgccatatgtcattattagctgcggagctattgcactgaccaagtgcttgaaaaaacaaatcatttcctttggcgtgagtgttaatgcacagaggctttgaaaaatactatgtgaaagtcattaaaaaaagaaaacctctcagcagattagcttccttcaacctttgtaagatcctgcttttgacggccaacccagtgctttccacactttctcacacattgcctgttatttctggtcaggaaaataaataaataagtgcccatctggccaagtatttttccacctttatatgaaccagaaataccaattgtttctaatgtgtattccccagatgcaatacttatcctctatttacagctaagccactgattactgtggaaaatattgtcagcaaaccataccccaaaatgtattgctgtgaaaggggaaaaaaatattacaaaacaaaaccctaaaccgaatcgataacagcactcatgtcttggatagatttacagaaagagaaggacgtcgctatttttatttgctaagagatgttgcctttttttatattaaaatatttaaagttacttctctgattgatctgtttcttttgagacataatcttgctctgttgcccaagttggaatgcaatggtgagatcatgactcactgtagccttgacctcctaggctccagtgatcctcctgcctcagcctcctgagtaggtgggactataggcgtgttgtcactatgcctggctcatttcttttcattttttttttgtagagatgaggtctcactctgttgtccagggtggtcttgaactcctgggctcaagggatcctctctctccttggcctcccaaagtactggcattataggcatgagccaccacacccagccactctgatttctgagtcttaatcaaagtagcaaacttataaagtagtgatttcatcacatgccaatattaacaaagaaaaaggaagagtagaaaaaaaactccataactgatactgtaaaatatttttctaatttgcataaagatatcagttctaccctagtatatttacaagatatgacaattcactaacatttacattttaattcatataaccagtttgtaagagaaggaatcctatcaaggaaaataagcctacagaaaactaactttttgtgataaaatgattttataaagctgacaataagcatttaaagaagtactagaacatgaacctttaacacatatccaatctactgttttagaaaaaattaagaatgagtttttctgcaaaaatgtatgcaacgcaaattctagtttaaagcggaatatcctgtaatctaataaatatggagatgattttttatagtgatgtaatgggctagattgtacctttagacttatgggaataaaaatattatttcctaatttcaaaactattttaaatcttttaaattctactaaattaaataagaaaataaaatttgagttagccactcaaacaggagatttgttattctgatttaaaaacaattgcctttggtaacaatcactctcaaacagttcgagaaaaatatatgtatgtatatattcatgggcaaggagaaggatttagaaaaggagaaaatttttctaagtttcggtgatcaattggaatgaaagtgtgaaattaccttcagcagtgttgtcaactaaactcagcactttctgtctcaacaggtgcacactcaagcccaccaactctcagctatttgtcaaagctaaggaaaaagatagccagtccccacacagctgcgcctctggctgccactacaaaagaatgaggctcggctatttttaggtttggggtaggcaatcagccaaatctcagcagcaccacaagagcatgtgctgagataactgagactttagagttgaaccaggactccaccagcctcccaacttcctgcctagacacccaaccctgtgttctcatttctgtggtcaccaagtcacctgtggctttcatcatgatccgcgaaatctacatttctgtgcttttcccagctcctctcctgttacaactttcatttcttatctctagaccttgaagccatgaaattttccttattagttcctttactcaacaaggaaaaaaaaaaacctcagaacactctgcagctgcttctataaagaaagcagtgtgggtttaatttgtttataatctgtccttcatttcattaagcctctaagtcatggccattgctaccactgtgcttaaaaacaagagaaaagtgaatgcttataaagagtggcaggtacaataactgatgtacaaagaaggaaaacacagattactgtgttttgatagttaaaagggagccagaatagggagctaaggagtctgatatcaatagcgtacattattttacctttgttgaatgctgatccagaaggttaatatgtctaagaatgtgcatttgtgaaatttccctatgtgctagcataatctcactaggtgttgcatgatttccatgaggaaagctgggttttagtggaataaattattctacattagatttttttgtcttctcataactgttttttatttgtaaacaaaagtacatgcacacatttacggtatcctcaggtattgctatcaaaacagtaataaaataacgcactattcttttttaatgatttttttttgttgtgaactgacatgagctttcatatacgaaatccgattttgaaatataaggcacatttattttgaaattaatagggaatctaggtcaaacaaagcaaagccaaaccttaattttacagaactgttctacctctacaaaaagtcactcaaaacaattgtttaaattgtgtgcaataattatcttgaaaatgcattttaacatgttcctataaatataattccatatgactaagatgaaaataataaataaaataatagtggaataaaattgatactttatttcctattttgattttatccccattattccagaacaaattcaatatggcagataaattgcaaggatttattttttctttctttttttttttttttttttttgagacagagtctcgctctgtcgcccaggctggagtgccatggcacgatcttggctcaccgcaacctccacctcctgggttcaagcgattctcctgcctcagcctcctgagtagctgggattacaggcatgcaccaccacgcccggctaatttttgtatttttactagagatggggtttcaccatgttggtcaggctggtctcgaactcctgacctcgtgatgctcccacctcggcctcccaaagtgctgggattacagatgtgagccaccgcgcccggcccagcaaggatttattttcagggagccagtattatgcagagatcagcctgctttagaaaatacagtgtctctcatgaatgagtgcaccatttgccaaaaataatctattgtatcttcttctcaggccaataattaaaaatgtattatactccaaagaaaaacgtaaataaaaaagacaatcctgtaaaattatatggttattgtatctctacaaaaacgtttttaatattgtaaaatatattatttacataaatatgtaaacattcaaattgaggagcaagttttagagtagggctcaaaatctcatatctgccacttattagttatatggccttgagaaagttacttaagcactgtgcttcggttttgttttttaatctctaaaatgggaagtattctttcctcatgatctggttctgaaaattaaatgaggcacaaatattcacactcccccagggttctctaatcctttccttgatagtgtattccctccgttagaaatctcgttctcttctttaacttcaactatcatctatctccatgtaagtgattctcaagtatttctctcttaagtctaactctttagttttagtcctcccccacaaaaacttttattatctacccacctggatagcccatcaacaattctaagttgatgtctcaaaacaaaaggcccttttccccttcccctccaattttgatcctattcctggtttctctacttctgttaatgttaccatcatctcaccagttcctcacggtgattagctattaacaattttaagaattccaacatatgcttcattaaacattagataaatgggcatttattgactgcatgttaaagaagttccatggtgaaatgagtttgggaaactaggttaaaagttaaacagctgtctttcctgcaggattccagagcatctttgcatatgcattacattgagaaactctaaggggatttagtatgtagtattcccctcagttttatgactaaagaagtcttttttgggggcgtggggccaaacagagggggcccataatgaataattactgtgccatagagcactcttgggggattaatatcagggagtctgctatcattattcccttttcctcatctcccacaatttagcaacaacttactaccaaataatttggttctccttgttgaatccctatctcattctgagctactgcttttgtaaatctggcctaggctacatgtaggctctcctttcactgccttttcttattctaacatctcaaactctcaattcaatatcttctgtagaatttgagatctattttctgtaagagatacaaagatgggtaagacatgatctctattgtcttgggatctgtgagagatgggaataggccagcagagttcaaatatatattcaataccataggcatagacataccacataaatgttgtgaaacaagaaatagcagtcaatgcttatatgggaaaggttacattaggtttttttaaggaagtgggacctggataatattagtccaggaacttctaaatgaaagatttaaaagtatttatctaccccaaagactatcttctcatcttaaactaaaaataagtttaaaatataattaatattttcacaataaaatgctcactggagaaactttgaaaaaaataaaaatgtaaatataagaatattgaagtaatccagcgtgtaatttcaccctagatacatctactgctaatgatgggtgaaattttattttggatatttgacttgtctacaagtcaacaattctaaagatttagcttccagagctaaagttttctaacaataatgccaattaaatgttttaaaaggttaattataaaagatatgatgattaaatttaaaatatcttgtcacctcctgttcacaacattttgcttttcatttccatatatcttaagtatacatctgaaagctatgtgagcgttgtaaattgtcaagttgaacttaacaaagtatagtttatgttggggaaaactcattaaaatgggatccatttcttaatttccaaaagaatcatctatatgaattgaacattgatttaatatcattgaatattcaatacccatatacacattagaatgtttttatgatttacattgcttacagcacagaatattcaccaatattattgctaagagtagagatatgactcaaaagtatcaatatttaatccagtaagtatgaagctctatgttaattgcaatcactattcataaacaatttgcccaacattgcctaaacatttcttgccattcaagggtttattttttgccttctgtgaattagagtatgatagtaaatggtaataaatgatcttaagtgatagtaaataagtaatttctataacagaataacttttgttctagagatatgtgcaaggcacaatatcactacactcaactgtatccaaagcaggccacagatccttaaagagaaaacttaggaatttactgtggcaacaggagaggaaaaaagcaaataaaaaggaaatgtacaaatgtaggtatgaggaggatgtccttttctaaaaaaaataaggtagtttagcatagttgcaatgtgtggtatatgagtggggcaaaaaatgaggtaggaaggacaaataaaggaccagtaacgaagagcttttgaaatttatttcaggtctgggagtgatgattttgacttaattccctggttttctctaatactgtttgttgttgttgttttctgcatatatagaaaattggtagattttatacatgtgcattacatatgtattggtagattttatacatacacatatatatgtataattacgtatatacatatacaattgttgaatcattaagttgcaataattaaatttattactctttatgatgctgtgggtattacagaagcattgtaaggtactacatggtcctcttataccatagattttttctaaacctacaactgtatagcgtgtggtatgatatgaaaatcactggctgagaactagctgggtcttagttttgtatctaactgtttctgagaactggagtctcactttccacatctatataatgaggaaatggaaaatattctccaggttttctgcagttgtgatgatctatgaccttgttattcactgtagggtgttaagctggtgaaacagcaaaactgcagaccaaataccagttttcctttaaccatctctctctctctctctctctctgtctctctcatcatctatctaacatctactattttaaaaaatcatcagtcttctcaatgcatatcttactttctccattttcccattcttccagccctttgctcttttcggacaccttttatttacccgtctacagttcttttgccctctggtactttgtggttaccagttgctattgtacttcccacaaaggatcaatttgcactacaatcatactgacagcagtcctcagtaactcaggggaaaaaaaacagactcttaagcagcagtggggatccaaagaccatttcccagggaaccagtcgggtcacaggaagagtgggaagagaacagcaaagccccaagttattttcctcttcccacatatttcactcagatgccaatttttgtttgctctcaaagctgttttatttgacagggctccttgttatgggctaaattgcccctttcccaaattcgtctgttgaagtcctaacccccattgtctcagaatgtgactgtagttggagatagggtctttaaagaggtatttaaggttaaatgaggtcactaaggtgagctctaatccaatctgattagtatccttataaaaagatgagattagaacacagacaggaacagaggaaagaccatgagaagacagatggagagggcagcctctgcaaactaaggagggaggcttcagaagaaatcagccctgattatacctagcctttactactgtggagaaaataaatttctgtttaagaaacccagtctactgtggtattttgttatggcaatgctagcaaaataatacattccttattcatttgtaatgttttatatttgaattcagatcattctcattctcccctttgtatatatatatagatatatatccttcttgctgctagaacaataacaaaaagatgattaactgtaagcatagtgttacaatgaactctgttgctcacatgcccttagatatgtatttgtttattcaaaaaaagcattaaccaaataactttatatattaagccttatgctcatctctaggtatgggggagaggtgggaaacatgatgataaaataacagtatccgtgtaacactgataaacatgccaagatatttgtattctcatattaaagtaaataaattgacaaaatatggtgaaagatattgtgcattttgatgaacttatgctatgagaacactttaaaaccatacctaacctccattggcggagtcaatggagattggtgagaggggttaggaaataatttttcctgagatgaagtggaaaccaggctttaattaattaagtgattggtaaggagaaggagggtaatttcaggaagacttatccctgacaacacgaaagcatggtagtttgggggcccgcacataggagcctttggctaaagggttaggagtaagagatgaggagaagggtaggagaggaggtagcagcaataagctgggtcctgataacatgaccttacatacatcacggagttggcattagtctctagcaggaaaaaatattttccaacttttaagttaaggctaattttaaacttgtcacctgtagtaatctctttaaatgaatgaaatttccctgtcttcatttatagtaatcagcatctttcactgcaaggaaatttctaagtgaatgtacattttactcaacttctaatttcctttaggaatctaaactcattcaatattttcacaaaatgataactgtaatcaaggcagagagctttatttcagctaacaaagaatagccctacacaaaggaattgcaaatattctaaataatgactgttataatttatcttctctgttgaaggatactacttcctgttctgtttgtagccatgataaacaaatggtatcatgatccttatagtccaggaaatggactgttttatgtagatgaaatattattattataaaatctgtctcacattccaaacccagcctaggacaggatttatgataactgccccccatctatgctggatatcacactatgatgacgtgtgtatttgtatttctgtgagctcaattcataactatgcaactctcctgaagcataaacttggctacatcaaaatggctaaatatttggtctaatgtttttctttaaacttaaattataagtttagattacataccttaacttacttaaacaattggctggacatttgaaaaaatattgatctttctttctttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggaccacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccagcctgatctttctttctatacatataagctttctgtccaatttataaaaggaagtagtactaatatataatatataatattatatatatatatataatatataatattatatattatataatatataatattatatatataatattatatatatatataatatataatattatatatatatataatatataatattatatatatatatataatatataatattatatatatatatatagtgtacacctatactgccctagtaagaaatcaggaagtcagtattgatgatttgctctctactatttttgtctctctcctcattacccgcgcaaataagttttactaattaaatatctaaatatcttttgtttgcattttgtctttttcattcctaatgccctaaggctcttatctgggatataactgcaaccctcttacacctgcttttagaacagtggctctaaacacaatctgcacttggtgtgcctgtatgttctgatttcattggtctgcaagagttttcacaaaccctgtgtcatctaacaaatagatctgaacctcctcctttaaaaattcaagatgcaaaaataaacacttcttgacaacacatagtttgctttcttagcttttttacttttacttttttttcgttttttttgagatagagtctcgctctgtcacctaggctggagtgcagtggcacgaacttggctcactgcaacctctgcctcctgggttcaacggattcttctgcctcagcctcccaagcagctgggattacacgtgtgcaccaccacgtccagctaatgtttgtctttttagtagagacggggttacaccatgttggccaggctggtctcgaactcctggcctcaagtgatcttcccgccttggcctcccaaagtgttgggattacttgcatgagccaccatgcctggcctgctttatggttttattttgctcactgtctaagctagtactaggtgaggagtagatgctagaaacccattgtaatatgttgctcagagccagccatttctctttccaccattcatacccaaacccaaaccaaacaagaataatgtgagagatcagccatgctaggacctatcaattcagtcatcgttaagcaacaatcactagagacttagtacatgtgatatgtaacagcagtcactgtgtaaataaactcaccgcctattgtgagaaacagacctgtaaacagtggataaaggacaagaattgcatgcagttaaagaaaaacaggcaaaataccctgggaattcagaggaaggaatgccaaatcacccagttcacctacatctaaagaaggctttttttcttgttcatcaaaatactcgtgttggaactagcatgaagagtgtcacttcaccttctttggccttttttacccttttgtgtaaaagaagattcttgatcttcaaagcataacagtcatgttttattttactctatgagcagattcattaagaatgtgaaagtattcccattcattcaaattaacattaaaagacactctcccaatgaataagatgtcaaaaatcatgttagtaattgcagtcaatgaaatgaatgctctgctctcatgctgcatgcctatttgtactcatcgactgagcactaacgagaaatacacacctaacttagaacagcagaaggagcagatgctttaagataatatttctcagtaatatgcaacaatttaatttcaaatactgaacttctgggccttggaaattacatatacaggttttgcagtcaaatgagtattgtttagacatattaaatgtgctgagatctaaaatttcatcagttttcaaatttaagccagaggggaaatataccctaatggttcaaaaaccctcaatttaaattctggtttatatagcaatgatcttggttactttaaatttatttctaagccatgatttttttcttttagtggcaaatattacaataataaattcaagggaatgttaaaatcatacccaccaacaaaaagtaattcatacctctgaagttagctattttagttggacaatactcttaccttgcgacttatgctattagattcctgtgttcatctttttatagcacacaaatacacaggtgttcactcacacagatgcattcacgtacacactatgaaacttgagttttacaggaaaaaaatttctaaaatgtgtccaaataaattctaactgtaaaatttcttctctcggctgggtgtggtggctcacacctataaacccagcactttgggaggctgaggtgggcagatcacctgaggtcagaagttcaagaccagcctggccaacatggcaaaaccccgtctctactaaaaatataaaaattaggcgggcatggtgggacccgcctgtaatcccagttactcaggaggctgagacaggagaatcgcttgaactcaggaggtgaaggttgcagtgagccgagatcacacaactgcattccagcctgggcaacagagcgagactctgtctcaaaaaaaagaaaacatttcttctctcttatgtacaaatttctcactccatttttctccaatgggaatttaaatttggaaccactctgaagctaatgtaatcataccagatacataaatatttcaatatgtatagcaattgattttgttacagtctttgataaaagagatacagtgtatagacacaattttaatggtttcctgcaattggaaagatacttggtatattcatcaattagtatcctttttatacttctattagaaaggctatgtttttgtttaagtacccaagattccaaaagtgaatttgtatctatgaatacagtttaatgtgaacaattgaaacgcgcatgcaaaactcaaatgaattgtatacctggcaggcaggatgaattgatagcatgttatttttagaaatctgagtgtatgtatgcataattctagtttttgaagttatctgagagtctttccatatcatattatacccaaaaaattaagtgtcatcatctaatggtttgaaacaaaagaaatttataagtaacttataattctttccatcacttttggatattaattaattcaaaacacatttataaaacttcttcctagtacaaggaaatattcaaaactctatgagaatataaacacatagaagatgtggtttgcggcatccaggagtatataatctagtagcggagataatataatttttaaagttatatttcaaataatatagactcagttacctcatctgacaagtgagaatggtaatatattttttgccatagtttttataaaaccaattatatgtatattatctttattgtctttattatcattatcattcactataaaagataatgaatatatgcaaattaatttttcagtggtagaacttgatttctagatgtcatgaattagaactctactcttttccatttctcaatcagagtctatattttcaactttcaaaattgcacaccacatttctacaatgtgagccccaggcagaagaatgcttataagctttcatctaggcacaatatattatataaggcctggatggttttctggctggtcaattctctgcttttggcatacggagatcaaaattgggttatatgatctaatttagttgaagataatacaataatatacactttcattaagaaaaaatttaattatggaactatcatcataaaaattgtcatagataagaacaaagatactatatcgcatcttttctttggttgaaattttataagtcaaaatagattgtcatgtcacatacaagcctctttaacaaatctcctcaaagataaaatattaaagaaaaagttactatggtcttattagtttacagaaacttaattttattataaaagcaggtcagagggcctactacttcagtaaattaatgatatcactcaagctaagttttctcataaaatgcctgtgcataccagatctgtggatttctgtaatactttggaaattgaaagggttcaagacaccagtttttaaaaattcattattacatgaataatatgttaacgtaatatacaaaatatagttcatattcactggtcaataaaatattacaaacatttaagtgcaaaaataataaatatgaataggttgttagactggctctgtagatcctatttttgttttcagagtccattcaattccatgtatttgagtcatgcaataaacatttctcaccttgaatttgggcatacttgtatggggctccatgcttgtgcacacatatttatccagacactaagtttccttttataaatgagctcaatcccagattaaaacagatgaaagatttccaatcattgtggccagctcccagggtggaaaataagcttaggaatgcagcaaactgaaactgaatactctctggaatggacattccgttctaagtctccttcaggaaacctccaacaatagctcaagcaggagcaaacacttgtctttgaggtagtccaagccaaccattcactttctcagtaatctgtcctcagacacccactggacttagagctcctgtgcccacctcaaaggacagcagccctggcatgcatgcactataggagcagaagtgattctccaaatttctactctgctcacctctccaccactttgcatcaatttggcatctcctaagatatctcagctttgtaactcctcaaaggaatccccacaaattggggctcttttttaacttggacatttcctttgagactaagaaagaaagagaaaacaaagtacacagataaccaaaaacacgacagattatatgaatcatccaaattaagcaaccaacattttagtctaagatttataatttttacaatatattgagtacactggacaaaaaagtatctacttaggattatcccatcctgttctattttgtgtgtgtgtgtgtgtgtgtgtgtgtgtgtgtgtacaaaataatgcatgccagtattcataaggcttttccaatctgaatgatgcctgagtttcaaatatgtatacagtgatgtaatggctaaacaatagtcagataaatgctgtgtagtcattcatttgtgtacctacaagctgttaggcacaattaatccacatataataagcacaggctatctcctcaaggagcaagagagtgagtcagaagccgagaagcaaactgacagctaaaataggggatataattgcttgtctagaattatccatagtgagtttacaataagaatacatattggggccccattttctgacctagggtagtaaggaattcttttaaacaatattctataaggaaagataaaaataatattaatagtcattggtggaagagacatggtgatagtggtttttgggagaacattccaagaagtgggaacaagtcatagacacaaaattacatgaaccaaagttattttatttgctgaaccaaagtaattttatatctagacagaagtgttcctggtggggaacagcagatcaggaggtgagagacatgagcagatgccatactgtgaaagaccttgtacgttaggaccttggattttaccctgaagctagaagattctctaaaggacgttaagctggaggcacacaatcttatttgttttagaaactcaacgggggcagcaattacaaggtgggattttctgaagaccagattgaaagcaaggagatcattcacacacgcacaaacataaaatcagaggtagtcttttgatctatgtatctgtttatacaagttggtatccaaatgtacatttatcttttagagttatatacattagttatttgtgattaacaataatagttaaaataatacaaagaaaaattattctcaacactttgaccctcaccaagaaactttatatatcccccttttaaagccaacaataagtaagcttgtgaaggggcattatttttcctaatttcctcttgaggacagtagtagacatgctcagctcagtgccagaaatatggtaggctctcaattaatactagttaaataaatattggcttgtccaggattacttgcctttgtaggtagaggcaagtttaaaacccaggtagtctcaggcattgtcaagttaccatgcccgtggaccagcataacttctagcgcttgtcatatagggtttttggtcataaacaacctgaaacacaacaccttacaaagtaggacatatagaatacggcctccatcatcatgatattttattcaatcagtgatgcacgttcccatataatagaaatggattgcattctagcagattagcattaaaccatcctttgtaccttgagtgatagacttattaatttacaagacttatcctcgattaggtttggtgatgataccctagccttcagaaaaccaagagcttattaaaggtctaatgctgtatttttcaaatttttattttgcaatcattatagactcacaggaagtcgcaaagaaatatgcaacaatgtcttgtgcaaacttcactttacctctcccaatgttgataccatgtataactatagtacaatataaaaactgggaaattattgctataattcatagagcttattcgggctttaccagatagacaagtatgcacttgtgtgactctggtgtgtgtgtgtgtgtgtttgtgtgtgaagctctattcgacattatcaagtgtagctttgtgtaacaaacaccacaatcaaaatattgagcaggtccatcaccacaaggctccattgtggcaccattatatagcataccctctgccttattcctgacctctggcaaccaatatctgttcttaatatcaatatctgttcttaatatctataattatatttcagtaatgttatatacaagaaataacacagtatttaacctttgacttttttttgctcaatatggtgctcttgacatccattggagttgtgaatattgagtatcagtagttcattcctttaaattgttgtgtagtatttagtggtatgagtatataacagtttgtttaacagtcactcattgatggatacttgagctgtttcttgtttctagctactgcattcatgtcaaggtttttgggtgaacataaacatcaattttctgggataaatatcaagagtacaattgctgggctgtatggtgactgcatgtttaattttagaagaaactcctaaactgttttctagaatggttgtaccattttacattcccatcagcaatattagaaagacccagttcctttgcatccctgttagctttcagtgttgtcactgtttttctttttttaattttagccattctgataggtgtatagtgataactcattgtagtgttaatttgcatttctttaatggctagtgaagctgaacatctttttatgcatttctttaccatctgtatatcctcttcagtgaaatgtctattaaggcttttcccacatttttttccactagattatttgtggttttagtgctcagttttgagtgatatttatatattctagatactagttctttgagactttacaaagatagattaaggaaagaaaaaggacatgggttaaaaacagtaaaaaacaaaatcaagaaccacaagtgaaaagcagtatgggaaatcaaaaaagggaacagcacccaatgacaaaaagcaaatctttattatatatttatatatgaagctttaaccaaaatgaaagtgctttgtcatataaaattttcataaaatgcaatcaaaatatcattattataacatattatatgtaaacatctgtaattatgttcattaaagcattacacatcaagtaacttatttaaaaatatatatggggaaacctaatgtgtttggttccaggtaataaagtggtgagcaagaacagttgaggtgtcttggttcatagaacttaccacataatccgactggcaagtattaattagtcacgtacatacatatggaatcataacagtgctatgtgttatgaacagatgttacgtggtagaggaatttgatgtacttaggggattttgatgtctatccagaggtaagcttgtaggtggaaaatggtgtcatcaaggtaaaaaaggggaaacggggaggttctagacaaatagaaaagcatacacaaaagtactgtagataaaaaaaaaaagctatacctagtcagggaacaaaaagaaagccagtaagggggcgaggcaaaggaaacatgatgggaaatgagataggagaggtaggcagtgtctagactttgatttttaaatgtgttttgttttgttttgtttggctttcctagcaaccaagagaaactactaacatgatttaacaagtggtggtatcttcgaatttaattggctgcatgaagtttagagagtggattatcaagaatacgaaagagaatgcagagaaactggaaaggaaaggctgctgtattcctagtgagagaaaatatattgcgctaggatgatggtagaggagataaagagaagtggatgaaaatatattagaggataaaacccacagtgactggcaatgacttagaaataactgggtaaaaaagatcagagtttcaaggatgagatatgtttctggcttgtgaaactgggtgaatggttgcaccattcaatgataagaaaaacaatgagaaggaagcaggttttgtgcggtgaagagaaagttctgtttagggcatttagagggaggtgactatcacataagaatggagatgccacccaggcagttgaaatcacagttctggaattcattggagaaatctaagctagaggtataacttggttagttatctgtatataagtgttaataaagctgtggacataagtgcaatgatcgaggaagagatcattatgagaagagaattatgctaggactagatcccaaggaaacctaatttttaaaggctgagaagagaggatcagcctgcaatgcagactgaatacaaacaccctccaaagtagtagtgaagccatgagaggacagtgcacagatcttaaagacgacaacatttttaagaagggagaaaatggtcactattgaccttctgcaagttcaagaaagacgaagaaatttcattaattggttctagagacatgaagtcctctacttcacttgaacttagcagggtgaagcttgaatagaaaaataatgaaagcatgcaattaaaagaaaagagaatctcaatatcttgtccaactgatgcatataagagatagaaagaagataatactttgctttatttttgtatttttaccataacagaatttataatctaattttcttaaacaaattatcaaaaaagaaaccaacaaagttactgctaatgttgaatattaaagtactattattaatagcttcttaattaagaaataaataattatatgtttgttacaattgggaatgacatttgaatataataagttgtttttttttcccaaccgtgttgtagtgttctttacacttttcaaatggaaaaatgtattcagtgttgtattatttatcatgttactgatcttatcagtaaagccaaaaactttcatacgtaaaccacttaatttccaagtaatgtgtatgtatgtgtgcctctgtgtatgtatgatagacagaaagacaaaaagagaagatctatgcacactagtaatattgaaagaaatgagctaatttacttcattcatcacactgtcataaagactttcttttttcctagaaaagtggtatctcatacaacctcatctaatctcatacactagaaaaatggatcagcattgattaaaataaaataaattctaacaatttcttatttttatataatcacacatcttagtgtcattatagcagtaagttataaaaacaatgtatatttgtatatttaatattaaagagtagtgctacaaattaacctactgggtctccgaaatatatttctgaattaaggcttatttctatagcttatccaaagatcaataaccttacagttaagaagatgcattttaaataaatgttaaaatttatattatcctgatagttttatatactagttagttactggacaatactaaacaattgataccatggaaacgcacatgataatcaatagacttttttttttttttttttttttttgagacagagtctcactctttcacccaggctggagtacagtggcgagatctccgctcactgcaacttccacctcccgggctcaagtgattctcctgccacagcctcctgagtagctgggattacaggtgcacgccaccacgtctggctaatttttgtattttagtagagatgtggtttcaccatgttggccaggctggtctggaattcctgacctcaggtgatctgcccgccttggcctcccaaagtgttgggattacaggcatgagccaccgcgaccagccaataaccaataggcttttaatttgaaataaattattggggagtatttctgacttccctttgcctcccaccctcatttatacatcttgaataattctgttccatcacgatctctgacattatttttaaatatgtagatatgtgtgcattcattacctctttatgagatgagagaataaaattgcttgtgaagtcagagaaactcagtattatttctaatcatatatatgagaatgccaatgttgacgttatcgtacagagtgcacattgcttaactccaggggtgtcatttacctcatagcataatattaatagtccacgttactggtacactctagaattgtacagtgtacactatatgaatgtatgcaactaaatatcacactgtggatgactaacataatgaagataagagaaaaattagtttatgtaaaaaggcaacagtaattatagtaacttaaataacctactgtttatgccaagtactattcagaatagtatggcacgttaatctatgtaaaccatttttttacaatactaaatcatgttcaggttagcccagttcttagctttttgttcatgtagcacagttgcctgtacataactgaaataaactctaaaagaacaactagtgagaccactctaaggatggctaactgtagatgattacaaacaaaccagggctgcattagttttatttttgatctttttcatcttcacaaagtaagaagagtgagatagtaataaaattgtgaaacaagataactgttatggatattatcatagacagctccctatgcaagtctagagaatgggcatgagttatttaggatatctcagtttttatctaagaaaatataatatgccaatgtctataggctttgagtaaacaacccaaaattttaatgggttttatttttaaagagcatcctcaatgggacatgtctagttcttgttagaagatactatgattcctgccattttatattttgttctatcctttttagaattctattaaaatctgagagatcgtgacaactgactggttaagaatctttaatcctactgtcatgctgccaccattaaaatcctgactctaccacgtaccagctgagctaccttaagcaaattacttaatctccctgtacctctacatattcatctggtaaatttagatgattatgtttccccaccttctagagttaatatggaacttatcacatatgtatgtgatgtaatcagagaagtgcctgacacttattacaggcttgttaaatggtaaatacagtattatcattgaagattaggtgaatctagaatagtgctatgcacacacaaggtactgtcaatagctgtgtatgtaagacagatcaatgtttcattaatcctttttgcctcactgcttcttgcaatcattctctaattcacatctctgtatgtccatactcttatgcctatttataaaaatggattcttcaatgagaatgtccataatcacactattcataagtaatcatttatgattgatttgtaccatgctttataactttcttgatattttatagtagttgtacgcatatacatatgtgtgtgtatctgttctctgacttagagttgctgtctcataaaaagcaaagagaacataggtgttcaacaatgttgagttataagcaattaaaaacctaatgttaaaaaaagttgctcaatatcatattactattctatcgagtcttacttcctccaaagctaactgataagtacattacattcatccatgattagattgaattactcaaatgccttctatctctttattgtgattctggctttatttaaactgaaatgtcaatgttttctaggtatttttaccatttttgcagatattgggataatcactttcactaacggtcctccagaatttttagacatttctccaataagcatctatattaactaaactagcattaaataaagtgcaaacttaccttgtcataactatgcaattctgtattctctaaaggatgatttttcatattactcaacaattctgactgagcaattgaaattgagactatgataaatgttttacactgaaggctcatttcattatacagtagtcagttgaaatggggtttccgaagaaggtatttttaggaagtgcagagtacaggaaaaagctgaatacgttatacaatttaaatatttattgaagcttttctactaaggcaacattttggtaatattcacagaaatagcaatatgggaggaaattaggggtaaatagatggtagagactgtggaaaccaagacacctaatgctaaaagtgggatcctcattcatgaagtcattaaattggagatcgaaaggaacagacctctttatggaaatattattttccttagaatttcatcattttttctagatgtgtcttctctgattttttttttttagtgcttttgtcttctttattgaatttccgatctcctcttcacactctattatctttctagctggtctcatccactccatgagttgcatatttaaatccctaataatgacttcatttctaggcacaatacccacgcgctacataaaaatacaaaacaaaacaaacaccttagcatccacacccctaatccttcctgttgttccaatttcccttccaatctccttgcaaatggcaccattatccacccaggtgtgcatttcatggagcacacagcatgcaatacaacaccaattcctattgattctatctcatatacaaatcttgaatagatttacttctttcatctccactgtccccattctagtccaaatcaccttcttttggatgagctaccgtaattgcttcagattgatagtccttcatctaccctaggcacttgccaatctctttcacacaaaacagagtgatagtcttaaaaaatacaaatatgtttacatcagttttctacctgaaacccataaggctgtccattgatcttagtataaagagaaaaataatttctataaccttcaaggctctgaatgattggaccccagtcggccattcagatgcaagcttgttccacacttttctgccctcactgtactctaggaaagctgtacttgttttagatctttctccataccattttccacattcagaaacattgctccctctgacagggacatttttgctccctcttttcttttggacaactatactctaacctcattcttctttgccttgctttgaatattttttttttctcagaagtatttccccaatttcgaagactggtctaactctccctattatacattcttattacaatgtgtgctttattctatagcccttatctccaatgcaagtagtttgcgtgtgtgtgtatttaatatgcacatcctccttgaaatgctagtctctctttgagttcacttgtttagaatactatcgccagagcatagcacagtacctggcacaaaatgggcactcaatatgtgtatttgttacatggacaaatgaatcaataaatggataacaaatcatcagctgtaagtcccttctttaaactgtggtcacccaaaaccacacaatacaagttttagagagtcacttattttgatacttttatttttggatttattttgagagccaatccattttcagacatttaaagtaaaacactgcaaaagccataggcttgagcaaagtgaacctctgtgataacacttggtgctctctgacagcccattagagacggggtgtgtacacctaatccaaaggaatcctctagctcttcagcagctgttcacatggctcatgccctgcccttcagcgtctactaaatcaggattccccagctgtctgagcttcccgtaagcgattttagttaaccacctacaagccaacatttcttgcatctgattacgctctttaaagtctaatttcccttttgcttcctagttattttgcaacatgtgagtcattgggattcatcatttttacagattattattttttcacttactcaactagtttattaatattttgttcacttagtcaccaatttatttctaatacatcgttcttaagcaccaacataaaaaggaattactcaatttgcctttgatgaaaatacgtgggccattctgattttgtgatttttctttcttatttctttaatttttcctcacacagcttccaaggctaaaatctgcacttgtaacagtgtactgactcccttgccctttaagtcagcacttagctcaggctaaggtactattgcaaccgtaatctgataaaggaagagacaagttgagtgcaaataaagatgagtgccaggaatgagaaaaaagctactgatgtttatgcccttttatagtcctgattccatgacagtcttagccaaaagcagagtggaagaagggagaacgctttaaaacaaaacaaaacaaaagccaagaagagggtaaaaacatttaaagggtaagcattttatttgcccataattggaaataatatgggacaccgtaatggtaattgtgctcagctaacactgaccttttttaaaaatcaaaattttcatgatagtgaagacaacacatttaaaagttgacaaattagcaagagacttcgtgatatatatgtgaattcctcattgttgatatgcccatgtatggttttcatatttattaaatataaacaaaaaacatcatgattcgagcatctgattttttgaagtttctttaaaattatcttaatcctctccaaaacccattaagccatctacattctcatttcattacatggataagcattggctttaataatgcattttaatgtacctcctcttcgttgacacaaccacatttttctactaaaataaataactaaactaaaatgaataataaacaaaaataaaggcaaagctcttcctcagattcttttattcaaatggcaattagacctacatattattcaccagtcttagatatatttcagatttccaaattggcatgagaaaatcaattcatcaatttgctagcatttttaatttatggacaattattttcttaaaatggtatgtaatcaaaatactgagttaaaaattctgaaagagtcatttaagaacaacaacaaacaacaacagcaacaacattttatcagcatggcaaggaaatgacaactccatttcaattaaaggatcattgtccattctcccccagttcccattagtgaggaatggggttcataatgacagagtgaaagtgaggcattgagggagaaggcaaaagatcacaaaagaaagcaggaatacattgatttctaaaccaaatccagactactaagaacattggttttctcagggcttactatcattacatatactacgcaaagtcaccttcagaggttgtaggcctccagaaaattgctctgtgtgttccgttgcctactgaaattcccaagtattttgaacgagtgatatcagattaaaataaagatcgagctcagagttgaatagaaattatcccttaaaatggcagcctaaacagaagatgtgagctataaaagagggagtactgatctttgtgtttttaatgggaatgaggtagaggttgtatggccgtgagatgaggactctttttattttatttttttttaacttttaagttcagggctacaagtgcaggtttgttacataggtaaacttgtgccataggggtttgctgtacagattatttcatcacccaggtatcaagcctagtacccattagttgcttttcctgatcctcttcctcctccaaccctctaccctccgaaaggccccagggtgtgttgtttctctctatatgaggacacttttaagcataagacagcagagccatttcccttcctcattctcatttgtctgctgcctatcagaattgtgcttaagaaaatttatatgcccttaaaacgctggagccaaatgtatttttttggtctttttgttgggccatattcaaggaagtaatcttgaatggggaaacagaaaggctatgccctgggtgttaaagtatttcataatctctagaggagccatctggtttaagaaggcacattgaatgctataatatgctgtaatatatgagggaaacagactttttatactatcaagcctttcatgaaaaaatttcatgaaaaaataaacaaaatcattttagcttttaatcttggaactatatttagtataggagtgattcacaaatagcagagttactctcccattcgaaggggttatcagaatctctggaagacacattcacttttagtattaagtagagggagcttgaaattttgcaaggattttagggacaattctataagtgacataaatagaaaaaaccctccaaacttggtaaaataataaattatcccatggtgttgccattttaactttgatatctgtattaaaatgaaacttcagaactccaaacatatgtcaatattttatagcatgaaaccccaaggaagtctaactaatagatgttttacgtagggaaaaggtgaagactacaaactatttatttgcttggtttgtttgttttttgaagatcagtatactgcattgagcacactctacaaggggaaatattttcatgaaacctggttgcatttaataaaaacgtttatttcccacactgcagcccatgaccttccccagaaaatattccaatacgaaccaactgccttgataacagaacacaaacctcctaggactatagcaggactttgtgagaaagaaaaccattgcctctctctgaatccaatcaaaacctgaatgtactgtataaaaataaaccaaggtcatcattattccttgtcattgtgatttggcgtgccttcaaattatataccctgtatatttcaaataactgcaccgcctccattaactgagtttgacatcactttaatcaatgtatcttttcagaatgaaaggcagaaatgtcaaattcctaccattataaattcttttaactctctaatctgcattaaataaaaggttgtctttgagaaataataaatgctctaaagaaatataactagcatcaattttattttaaaatgtaactgggaaaagattaaatgtcaacacatctcttcatacagaggtgatttcccaagaaactattaaagccttacttacatgaggggcccctcccaaggctgtatccaattttctattatttttcttaaaatagcacccccaattgtataacctcaggccccataaatcctttcttcctggttcgttctgtgttgtcagacagggaatgtacattagtctcatttgtcaattccttaaaaaatgatgtgtgtttaaaatagaaaatttagaaaaatgaacagaaaattatctttaaagaaaggttaatttctaattagaccctcttaggaaactttataccctgtgatttgaatgcatataaatgtgcatatatataaatatatatactcataccaaaatactgtgtttcttgtatgtgtgatgaaataaagagttgatgaaaaagtatgataaatcatttttaataagttaggaaaatattacaatagaaggtggaaggagaaggaaagtttgggaaatgactttgttttactcttgagataaaattttgatgaaagataataaaatagaattttgaaaaacacctgatgtttccaagacaatgattttaatctcttttattaaactacacaagtggttaaaaacttgacaatttgtttcatatgtagcaaatgacatggagtacagggatttcaaatgaatgctataggaataaagaggaagctgtattaatatctgtgcccaaatgatgaatttgcaattcagtactgtctagctggaatagtgtcagccaacacctttttccccttaaataatgtaattatgcatagaacactttgtagtctttttttaaagtttagagtaacatctatatgacatactctattgtatttttcataatgttatgtcatgtaagatacaccaaaagctttgtattaacagtatatcatcaatttagatcagcaatctctttttcgtagttaagatgtctttaaaagattctgcagatgaaattctaaaaggtgattttattagacctcagatgacttacatcatttaaatatattcaaatgaaatgtctatttgcagtacactatttgaataattctttacaatgcattatttgagtaattctaaaagtgaacaatacaatatgtttgacaatacagtgatctcttttaaagggtaactgttttggttaaaaaacaacaaaacgtacttttgtaagtttatcaaactacggcaaatttacaaactggattcaaatgtcaaacatccaagtagcagtatgttgtcaaacagcaaaatttaatgtataatatagccctgagtatatctccgttttttcttaccaaactcattgtcatgttgcataggcattacttgatgattttttaaatgcagcgtgaaaaaatcctacagggcatgtcccaaaaagattacctttcttcgcattctaagaattgaaagttatttgaatatctatgacaaagcagagtgtagatttaccttgcttaatttcagcagaattgcatatattctttcaaaattgctctatatacttgtatatgatgttaattatgtagaatatatatatatataaaatcactagtgattttgatggtatttatgttacatatatcaaagaaataaaaacaaaaaataaaaatgtgtgtgtatattgcaaacaacagatatatgccatgcatatatttgtaatgatagtaaatataatagtttttcaatctaaaagtaataatgatgtccaccaaaagaaatttatgaagcaagccaacaatgtaagtaaatattgtattataaagtctggtagcttttaatgtgactcaatacatggacaatgttaacttatttccacaaagttttcccagtggcaaaacttctgcctttttttttagtagttgtggagcattacttatttggagagatttattttttcattcttaattataggcattgccctcatatctattttagaataactacactccacaagtcaaagatgggtggggaagagataaactcccatctcttcgggacacacagtccttatcatatattatttttactgttgtgccacagtccatttttaaatccttcattagtcatcatgactttcttaaaaataaacgaaatagttgtatttctatatgaaagacaaactaaaaaattgaactgaaaagctggctcataatagacatgaaacaacaaggtgactttactactaaatataattaggagttcctcaagtttgtatgtcgtttacccaagaaatcatctgatcatttgatagcatagatcacatcattatttgaaataattatcatgatatgctacagaaaagagcatttgaaatagtaaatgtgagtaagaaacattaaaattaaatctttatcaatacttttcacatccttcaattatccgtcccaactcattttattctttattttatccatgatgtgtcagagaaactttttctaacttttaggcctccatgtagttcctatacagtagttagttcaattgagaatatatgtcaggtcagtaacctttatgtaactgttactaaatacggaagtatcaactaatcaaaataataactcagatatacaaactatctcacagcaatcaaaataaatctgttatagtcaaatgacattctgcatattctattactgcagtggtttgttaatcaagaaatcatgtgtttagttctatcgcaaagaaaaacttttacactccatttctgttgaaaagttttcccaatgaaaaatatatattcctgaataaatacatatatatatgcagtatatataacatttatgcttctttgcaaactactgtgataatttaaaatcaatctacctaattagtgagcttgtcacaaactaaacgttatgccacagtaaaatatatttttagttactttgtacttacaacagtcctctacttcttcccaccaaagcattttgaaaagtgtatatcaaggcagcgataaaaaaaacctggtaaaagttcttcaaactttattgctccagtaggcttaaaaacaatgagaaaccaacaaacttcagcagctttaaaaaaagtaacacttcagtttttcctattcgtttttctccgaaggtaattgcctcccagatctgagtcctgtagggggaaagtgagtgatcccaacactgagtgagtcaacacagtaactgatgccaggattctgtagaggcccccggatatttcaaattccaggacctgcgcacaagcaagtgacccgccttctctctcaagttggtttcccataataggactgtccatggtcactacatataaggttgtgcttccagcatggcaagctctgtgaattcaaacaatgctcaactgtgttctgattaatatccaaaccagaatagcacagtggacatagtacttgcttttaaagccttctaaacacaaaaactattcagtacaaaagcataacaatactttctgtaactttcatgtgaatttattaacagagcagaaaatccggattcaaaattgacttttaaatgccttttttatcctctcaacaacaccaaaaatttcactctaccaaataaaaaggaatgcccagaataatccatgcatttgttatgtatccactgtctaccaaagttattttttccccttgggattcaatcaaaagttatgtattgatgatgccaacagtctgaataagagaagcagcagcagaatgcagcagctgaattctgaaggcagaatgtgtgtgtgtataggtctcatgggacatgttttcctgctaaaataaagaatactcttataatgcaggaaagaaatttttctcaaatcctaaatttcagttgtgaattatgctaaaacttctttactaacaaattattctttcttccatttctctggtgccaattcttaaaacaccatttttttagacattgagttaatgatcatttaatggttctgaatagaggcttgttttctgtattaagtgaatacagttgtattatgtcattcagcatgtaaatcattctttgccaatagaaagcttcttcatcttgttccttattacttttatgcaacaggcgagcccaaaattgatagaaaacattggaaacattttttaaagaaagatattctttttatagttataataatccctactaaaatttttgtttgagtgtttttattgtaccatttgttaaagtgacagactcatttttctatgtcaaacattcaactgcttgcgactgcaatgagtaatagataaaaattaaaaaaatattgagtcagactgtgatgtttaccttaatagttaattgtacattttgtgttttagaatattattgtcataacattgctattttccccagcaaaaggtgtatgagataaaacataaggcctaattttaatttaaaacattcttttccctaggtcacctcctttcctctcagtgtggttgtctaaatatgcatataagcaaaattttcataaaacaacatagaaaaaatgaaaaaattgttttggggctgatttggctctaagtctgcatgttagcatcagtgtccctctatgctgtgaggtacaatattgcccagagtataagtgccctttgtatcttgcactgtgagttttctacaaacataaacccttgtttaggccaaggcgtgaatacaacttgtcggtcccaaaccaacatcaatatcacgtgggaacttctgagaaatgcaagttgacacgagacctcaaaagtcagaaattctggggttgggacacagcactctgtgttttaccggtgattctaatgcatggtcaactttgagaaaccctaaagtgtatgtttctaaaaacaaccgtggttctaaatgtaacaaagatgtgtcctgggtaatgtctaaagcaccaaatcctgatagatctgaatgccctgagatacatttaattgccattcagccttagttgataatcagaatttatttggcacctataatgatttctgcattgtgtggaatgcatatacttcccttaagattttataatccaggtgcaaatatatgcttacaataactggaaaagtgaaaggcacgtaaaataaaatttagaccgaacaaattgaactccagttcagactgtgtcaccacagtactttcttgtgtcccttaatcacttatctttctcctttagtcctcagaataactacatcttgtaggtcttattagccccataataaaggaacttgctcaaatttccatttttaataactgtcacagaatttttaaaaatttattttaacttgttattttcaaatacttatagattcacaggaatttgcggggatagtatacagagatcccatgtacccttcacccagtttctcccaaagattaactacaataactacaattcagtatcctacaataactacaattcagtatcaaaaccaggaaactgacattgatatgtatacatatttctatttcatcactgatttgtgtaacctcaacctccacaaataaacacctgtttcatcaccacagagatttgcctcatgctacccctttacagtcacaacagtcaccctccctaaatatccctaaagcctggtaccaatcaatttgttctccatcactgtaattttgtcattttaagaatattagataaatgcaatgattcggtatgtaaccttttgagattggctttttttttttttttggcattctgtacttgagatccatttaagttgtcatcaatagcttatttccttttattgctgagtagtagttcatggcatggatgttctatagttactttattcacatactgtgggatattttcgttgtttccagggtttggtcactacaaataaagctgcaaaacaatcatgtagtttttcatttttcattcctctagattcatgtcccagagtgtggttataatttaccatataaattttagaataagtttatctacaaatagatctacagatctatctacagaatatctttcaggtagaattttgataggaattgcattaaaattatgaatacattttggaagaattgatgtttttaccgcattgattcctccaattcattaacatagtacatatgtccaatatttaggttatctttaatttatttcatcatactcggcttttttacacagtgctttgtgttgtgattagatatattaatatttctaatataatggcactactgtcggttatgcatgtgattgcacaaaaaaaggaaaacagcagagtttccaaaacccgttcttttcctgtttgtttttgctttttaagaaattttcatttaagagatggaggcttgctctgtcatccaggctggagtgtagcgacacaatcatacctcgttatagtctcaaactcctgggctcaagtgatcctcctgcctcaatcttctgagtagctgggtctacaggtgaatgccaccatattcagctaatttaatattttttttagagacagggtcttgttatgttgcgcaggctggtctttaacttctggcctcaagtaatcctcctgcctcagcctccccaggagctgggattataggcatgagccaccacactcggccagtttgtaaaaagaagcacatttaaaaatgtttacgttgttaaaaaatgttatatgcttgttggccgcttgtatgtcttctttcaagaagtgtctgttcaggccgggtgtgttagctcatgcctgtaattctattactttgagaagttgaggcaggcagatcgctttgagctcaggagttcaagaccagccagggcgacatggtgaaaccccatctctaaaaaaaatacagccgtgatgtcaggcgcctgtcatcacagccactcaggaggctgaggctggagaatcgcttgagcaggggaggtgaagtttgcagtgagccgagactgtgccactgcacttcagcctggactaagagcaagaccctatctcaaaaaaaaaaaaaaaagtgtctgttcatatactttgcccatttttaatgaatgtatttgtatttggtttgttgatttaagtttcttatagattctggatactaggcctttgtcagatgcatattttgtgaatattttctcccattcttcgtctgtttactttgttgatgtttcttttgctttgcagaagctctttggcttagtcaagttccacttgtcaatttttgtttttgttgcaatggcttttggggacttagtcataaattctttgccaagaccaatgtaaaaaagggtacttcctaggttttcttctaggattttttacagtatgaggtcttatatttaaacctttagttcaccgtcagttgatttttgtatataatgaaaagtagaggtccaatttcaatcttctgcatgtggccagccagttttcccagcaccatctattgaataggaagtcctttccccattgcttatttttgttgacttagtcaaagatcagatggttataggtgtgtcgctttgtttctgggttcactattctgttccattggtctatggtctgtttttgtaccagtaccatgctgtttgggttactgtaggcttatagtatagcttgaagtcaggtagtgtgatgcctcttgctttattcttttagcttaagattgctttggctctatgggctcttttggttccatacaaatttggattagtcttttctaatgaaaatgaaaaatgaaaattgacgttggtagtttgataagattagcactgaatctgtaaattgctttgggcagtatggccattttaacaatatttattcttccaatccaagagcatgaaatgttttgcatttatttgtgttgtctctgatttctttcagcagtgttttgtagttctccttgtatagttctttcacctccttggttagctgcatggtcatgaaaaagaatgaaatcatgtactttgcagcaagatgaatgcagctggaggccattatcctatgcaaattaacacaggaacagaaaaccaaataccgcatgttctcacttataaatgggagcaaaacactgagtacacagtggacataaagatgggaacaagagatactggggactactagagggggaatggagggaagcgggtgtgagctgaaaaactacctactgggtacaatgctcactacctgggtgactggatcatcagtaccccaaacctccacatcacacaatatgcccttgtaacaaactcctgaacatgtacccccgattcaaaatgaaagttgaaattattttgttaaaattttaatgaaattacaattgtttacagatgaattaattagacatacatttttcaaaaatataaagcataatttttattacagtgaactcatacacatttttttaaattacttttttttgtctacacttagatgatacatgttgtaaaatgaagactggcccatgattatattccaatattaaccagtcatccttgtgttattaaatagatggcatattaattagaaagaactgaatatggtaaacgtaaagtgaacaaggagttaattcttaaataattggaaaccctaaaggcattattttatattactttggaagtgcagggtcattttcccaacttgtttgattatttaatataattccaagcattatgattaatgcagcttcacaggacaaataagttgaagagaaacaggcttattaggtaatatacttatataaaattcacaaatttattgattagggaaaaaatcattatggatcatttctacttcctttttccacagtgatccatattggttgaaatgttacccatattataaggcatatatttcttaggtgtttaaaaaatctctttagttaagtccaatgggaaaatatgctagtttgtgagtgagtttataggcactaggaccagaaaaaataagacaaatagaattcaagcaatttggagggtgtccaaatagacaaaaatgtttcactgatgttttgataggaattgcattcaaactatagattagttttggaagaattgatatatttactatgttgtatcctccaattccattaatacagtatatatctccgtttatttaagtctttgcattatttccttagctttttagtttgtagtatatagatctggtaaatgttttattagattcataagtatttcattgtttcagagtgactgcaagatactatgtgaaaaattttgggtttcagtagttaattgcttgtatacaaaaatacaattaatttttaataatcattttactgtgataagatttaatatgagatctacccaacgaacagattcttaaattataatgctgtattgttacatatagatacgatgttgtacagcagatctctagaacttattcatcttatataaatgaaacttcatattcattgattagcaattgacttttataagttgatcttgtatcctaagaccttaacaaactcatcatttctaagagtaactttgtagaatacctgggattttacatagatcatcataacatctgcaaatggagacagtataacttttccttcctgatttgtacgcttttatccacttttcttgcatttttacactagctagaacttccagtactatgaataatagtagggctgaaagcaaccgtctttgccttaatcctaatattaggaagaaaggtgtaaattctttcattattattacaatgttagctataagatttctgtagttattcttttccaagttgaggacgttctcctccattgttagttttctgagagcttttatcataaatggggcactgaattttgtcaaacgttttttcccctccatcaattgatatgatcaagtgattattcttctttagcttcttaatataatgtgtaaaaatttgttaaggctttttgtctctatatccatgagttttattggtctgtaatttgttgactcttctactgtgcttacctggttttattatcaaaatacttcttcctcataaagtacatttggaagtgttgcctcctcttctattttctggaagttgacagttctctcctttcatcacttgaaaaatgtcatacttcttccttcgggctttcatggtttcacataagaaatcctctgccatttgaacttttttgcctatagataaagtgtctttttctctttcactgtttttaagactttttttaaaaaaaaaatataactagttttcagacatttgactatgatgcgtctaagcatgagtttctttgggtttatcctgtatactcagctccttgaatctgtagggttttgcattttacaaaatttggtatttttcaatcattatgtgcttgagtacttgttcaacaacaccctccctttttgaaactctgatggcataaaccgtagatcttttattataatcccataggacaactgagaatattttcattttaaaaatcgtttttttccttcttgttacgactgtgtaatttctattgtcctatctttctgcacacagatttcccctgtctcctcacctccattctactgttgagaccatttattgaacttttttttgattacgatatttttagttctaaaatgtcatgtcgttctatgtcttctatttctttctgacttttcccattttttatttgttgcaaaatgttttaaaaagcttactcaacaattttcgggatggctactttaatatccttgctagataattctgtcatctttgtcatgtcagtataagtgactactatctttttgcattccagttgagattttcttttttggcatttgggatattacattatcagactctggatcttatttaaatctattttagctcgtccccttctgactgttctggtggaagatagaggtagaagtgtgctgccttattgccaggtgggagtgaaggtcctggttccccactccatctatggttgatactttagagattattgtgtgtgtgtgtgtgtgtgtgtgtgtgtgtgtgtgtgtgtgtgtgtgttctgtaaataaattttacttgacaccatcttaattccctttaaaattagtaagtagatatctggaaccttgtgagttcatttttaaatgttcagatttttttttccactggacaaaaaaaaaaaaagagctttaactcacatttccatagacaatgaagcccatggcattcacataacgatgtgatttcaggacttggtactacatatcagtactatctatagagtcaagaaagaaaacatttgcttaccaaatataagcaaaactcaaaactaatttgcctgtgttgtgaaaataatgactcctcactttgtggattgattcccaactgttttatgaggtaaatgtacagggattaatgaagatttttaaagatttctgaatgtaagaaaggtattatgagtacaaagatagtaaatgcattgatgctagtgagctgagaatcagtaacatgttttaatagttgtatctcttatggggtattagtgaagatcctggtaggaaatataggtagcagattcaaaagcatttaacagataataattcggtgaaagaactatggacaaacatataggcaggctgatgagaacaaataagggatggtgagtcacctagcaagcagcaagagaggtaatttgtttctacctccaggcctaatatgtcaaggtaaaggaataatgttggaatagcaatagaaaagggcagtcactaccaggaccttagtgaggcatatgtgaagtggaacacaaatatccaaacctttttttcccttgccctctgatgtccagctggtgtcacataatttcctaaaagttagtgcacaagaggcgttggtgatacaaatgaagagacaagctttccagggcaaaaaacagggcagagaattgcaaaatgggtgtggtagcgaggagtggagccactgccactaatacaactgaagaatttttagcaagcaggctcacccctaccatttcagtcttggatggatactcagtactagtgtgataccttgtagaaaatatgatcaaggatgaatagatcctacgcaatgtagcctttgccttcattttcaaccctacatctctgaacttccttgagttatgttatgtgctttcctactattatatctcagattatttaaaaaattcatcatacatgttttctgagcatgcagctttactccctttttgcatgtgtgataaataaattgggtgtatgtttaaggtgtttcttacctgatggaaggcaagctccatcaaaacagttgtgtcttcctttttagttgctttatcactattgcttgtcattttgttgtgtgaataaaattgtctccacttgcaatttctttgtattatatcctttgtgtattatatgctccctcattcttctgggctttgtttaaatttactttatgaagattattttttttagcttctcctcactcccactcatagatgggtctaacaatatgaatgcatctttactactcagctgtaaacttcttgatattaagaattaattgctatttatattatgttgataactttagctctcaaaagcacattgggtgtaataggagtttagtgatatcagttggaaaaaaggaaacaggcaagagagggaaataaagaaatttatgatccagatcatcataaaatttaaaataaactttgaatgtttgagagtagcaaaccaaatctctttgagagtgtatgctaaaagaaattatgaaccttggtactatgggatgaccatagtgacaaattctcatttaaaacaatggaactgggccgtggaataaatgtgtatttatttatgaaacatttattagggccagattttctgcattaaagatatgagctaacaacttcaggtccctgccctcaaatagattataccttgggtatattaaaagaaaagttgacattttaatcgacctgctaattgataaacttcaataagcttgaagactttcgtctcagagaggtacctaatagcaagaccaggttttaaagataacaccgtatgcactgcctactataaaatattgtcatttaggttaaattaagcattgcgttttaaaaagctgctcccaaacgcatacactagacaagatgaaaagtctcagatcaataatcaaagttctcatctcaagaagaaaataataaagagtaaaaactaatcaaaataaaaacagaaaaacagtaaagaagattcattaacaaagagctattttttcaaaacggtcaataaaattgacaatgtgctaaaagtgacaaagaaaaaattgagaggacacaagttacccgtatcagaaatgaagtagggaatattactacaggcctggaaaatacaaagaaaaaaaaagacagtaagggtttactatgaacaattcttcacataagtatttaataatttagatgaaatagattgattcttcaaaaggcacaaactactgtaaatcaatgaatataaaatggataatttgaatggcctagactttggctatttaatagtaatttggatatactagataatgagtataactgttaaggaaatataactcataatttaaaaacttctacaaaagcaaacttctataactgcattggaaaagtatgccaatcttgtgaagaattaacaccaattctacacattcttttccagaacatggaagggaagaaaacaattctgagtatatgtgttgagtccagcaatagcctgatacccaaaccagaaaaacagtacaaaagaagaaaactataaatccatattccttacaaatattaatggaaaatttattaatacaatttcagcacataaaattcagcaatgtactaatggatcacttggggtttatttccaggatgtaaatctggcttgatatttgaaaattagtcactacaatctaccatattaacaggtcatagaggaaaaatcacacgatgttatcagtaaatgtactaaaagcatttgacaaactgatatatctaatcttgaaacaacctgtctgaaaaataggactaaaggagaatttcctcaacttaataaacaacatctacataaacctacagctaacttcatacttaatagtgaagtattaaatgctttccccttaatattgtgaacaaggcgtgaatgcacacgctcaccactcttattcacgtactgctacaagttctagccagtgcaatgaggcaagacaattaaatcaatccatacagatgggaaaggaagacataaaattgtcccttatatgtagatggcatgaaaataaaattttcaagctatctataaataatctcctagaaattattgataagtgaattcatcaaggtagcaggatgcaagataaatatacaaaaattgattgtaaccatttacattagcacctcccacaaatgaaattcttagatctaaaactagcaaaatacataccatatctatatgaggaaaactgcaaccctctgatgaaagaaatcatagaagataatccatattcatggatgggaaggctcaatatttttattatgtcagttattctcaaattgatctatagactcaatgtaatcccaatcaaaatctcagtagttactttgcagatattaacaaagagattctaaaaatgatatggaaaggcaagaaaccttgaatagccaaaacaacattgaagggctgggcgtggtggctcacacctgtaatcccagcactttgggaggccaaggtgggcagatcacttgaggtcaggagtatgagaccagcctggccaacatcatgaagccccgtctgtactaaaaacaacaaaaattagctgggagtggtggcacacgcctgtaatcccagctacttgagaggctgaaatgaaagaatcgcttgaacccaggaggcggagattgcagtgagccgagatcatgccattgcactccagcctgggtgacagagagagggagactccatctcaaacaaacaaacaaacaaacaaaaacaatattgaaggacaagcacaaagtcagaagattgagactgctctacttcaagacttcggtaatcaagacagtgtcttattggcaaaagaagagatcaatggaacagaatagagagcccaggaataaacccacataaatatagtcaactgactgatgtttgataacggagcaaagacaaccttttcaataaatggtgctggaacaactgggcatccacatgcaaacacctttcacaaacattaactcaaaatggatcagaaacttaaatgtaaaatgcaaaactataaagcccacagaagataacataggagaaaatctatatgggtctggtgatgactttttagatataacaccaaagacatgacctatgcaagaaataattgataagcaggacttcattaatattgaaaaattctatgctgcaaaagacattgtcaaaagaatgtaaagacaagccacagaataggagagaatatttgcaaaagacatatcaggtaatggactgttatccaaaatatacaaagaactgttaaaaatcaacaataagaaaacaaacaactctattttaaaaatgggcaaaacaccttaacagataactcaccaaagaagatatacagatggaaaacaggcgtatgaaaagacgcttcacatcatatgtcatcaggaaattgcaaattaaaacaacaatgtgatgctactacatacctcttagaatggtcaacactcagaacagtgacaccacccaatgctggtgaggatatggagtaataggaactcttgttcattgcttgtgagaatgtaaacttgtacaaccactgaaaatcagtttaaggattttttacaaaactaaacatactcttgctatatgatcaagtaattagactctttggtatttacccaaataagctgaaaacttatgtccgcacaaaaacctgcagatggatgtttatagcagctttattcataattgcctgaacttggaaacaacaagatgttcttcagtaggtgaatggataaataaactggtacattcagactatagatgctaaaaagaaatgagctatcaagacatgaaaatacactaaggaaacttaaatgcctgtttctaactgaaggaagccaatctgaaaatgcttctatatactgtaggattccaactatatgacatccaggaaaggtaaaattatgaagatagtaaaaatatcagtggttgccaggggttagttggcagggaggcatgactaggcagagcacaaatattttaggtcagtgaaactactctgtatgatattatcatagtagatacacatcactataaatttgtccaaacacacagaaaacacaacaacaagagtaaactctaatggaacctatggatctgagttataatgatgtgttgacgtaggttcatttattgtaacgaatgtaccactctggtgagagttattaataatgacagaggccatgctcgtgcgggcacaatgggtagatgggaaatctctgtctttcaattttgctgtgaacctaaaggttctccaaaaataaagtctattaacaatcacttgcattctgtgaattaataatgaacatatggacatggaaatttaaaatatagtatattttactatgtcacaaaaattaaatataaatctaacaagccatgtacttacatggtgaaagcaaaaaaaagttttagaagtaaatcatagaacatctaaattaatgaagaaatatattgtgctcgtggattgagagattcaacacagtaatgtcaattttacccaaactgttacacagtttacacaatttttatcaaaatctcagcaatatttttggaatttaggtgtaggaaaaatttatgtgaaaaggcactctaaaatttatgtgaaaaggcaatggatttagaatagctaaaacaatgttgaaaaggaagaatgaagtaagaggaataagtctaccagactgaagacttattaaatagctacagtaatcaagatagtgtggtgttggtgttgggatagacacgcagattaatggaacagaatagagacttcagaaatagacccacacaaattgctcaactgattttgacacagtgcaaaataattcagtggagcaaagatagtcttttcaacacatgggtcttagaacaagtggacaaaaataatggaaagaaaaaagaagaaaaagaaccttgacataactttacaccttatgcaaaataaaatgcaaatagatgatgaatttaaatgtgaaacacaaaataataaatattttacaaaaacatacaggagagtcttcaggatgaaaggctaggaggagttcttagatttgacgttaaaatcgtgtgccttaaaagacacaatttgataaatttgacatacaaaattttaaaattttgctctgagaaagatgctgccaagaggatgaagagacaggctgcacatcgagaaaaatacctgcaaaccatatatctgaccatgcactagtatctagactaaatgaagaattcatgtaacccaaaagtaaaaacaaaatagacacaaaaaaatccattagaaaaatgggcaaaagacatggagacatttcaccaaagacaacacatagatggcggataagcttgtgaaaagatgttcagcatcattggctcttagggaaattcgaattaaaacctcaatacgatataactctgtgcatattagaatggctaagttaaaaaatagtgacaacatcaaacactggcaagaatgcagagaaatgagatcacttacacattgttggtggaaacatgagatggtaaaggtactctgtaaaagtttggtgcattgtaaaaaactaaacatacaactaacctacagcccagaaatttcattccatggcattaatcccagataaatgaaaatttgctcataaaaaaactgtacatgagtcttcatagcagctgtatttgtaataggcagaaactggaaacaacccagatgtccttcaacaggcaaatggttaatcaaactggcatattcataccatggaatactactcagcagtacaaaggaacacattgttgatgcacattacaaatctggaagaatctccagagaattatgctgagtgaacaaggctagtcctaaatagctacataatacagggtttcatttacataacacttttgagatgataaaattatacaaatagagatcatattagtagttgctagagattaaggagtgcctgagggcaggaaaaaagtgggtctgaccatgaaagggcaacatgagtgatccttgtggtgatggaaatatcctgtattttatctgtgctgatgtcaatatcttgttgtaatattgttctatagttctgtgactttaccttaaggagggactgggtaaaatggcacacaggatctttctgtattatttcttacaactgcatgtgaatttacagttatctatctatcttttttttttaaaagacagtgggctgggtttagcctatgagccaaagtttacagactcctgccatacgacactgacattcgtgcatacaaataaatataagataaaactacattgtgaagcctgatggagattaggtggcatcaatgtcatgtttaacactgttgcacttgcttttttttgttaaaaggatactgcaactagattatataacgtaacacacttaaaagaattatctaattcaggaaaattttaaatatgcaaatcagaattctgggtatcgtttaaataaaatatttagagtcttgtaaaaacaggctctcagtgccattgtgttattgttaatactcaaaactgtttcataagtttatttattgaaagcctagaccaagttattactacacaagaaagagtaaagaaaacaatataaatctatgtggatgacattttagagtgcaacttcagcaaacttgtaggctcaaattaaaatcctttcctaatttctttctttaaaaaagcaaaagaaaaaaatcccctccctgttagaattatttttttactctgttcttaaaaccaccatttttttccatggcaaggctaagttttcatcctgataaggtttttctgaaggtttaatgtgtcatcctaagaaacaattggtaagaattgataagaacagaagatccaacgattgcggtgcctaaagctcgaggctattcttagttgtgcatatttttcgagcacgtgattatatgaaagttctgcacatatttttgaagacttctatgaaataaaggggcccaaaagcttaagcttcatttgcttcctgacaactcaaatcatctggaaaggagagaagctttgagaggatttatgtagcagatgaagctgcacatgctattttctctaatagtttttaaagagagagagagagagagagagagtctttgagtggcatcctgttttgaatacctcactacagaatgccttaaaaagaaatggaaagaaaacacaaataaacaccatttataatttggttcaaaattttctgagccccacaatgaatatacttactcactgaagcctgagagtcagagcctgttaatggaaatcagagaaaatatttgattcgaatttaaatgaggtttcacaaatggattgaatttagaggaggataaaaaaagttttatattggtttatgtctcaaaattctgttcagttttataaaatgtttaaacattgtgaagtctggttatttgaaagatagcttttaatctatagtatattaaagattagtgcttaaagtatattctgggtttaatagatgtctaaacaacctaaacaacctaaagcatttatatttccttaaacatttttaaaatattgaaaatcttatggtgaatctttagagttaactttatttggaatattgagaagtatgatgttattgaacccaagtttaatatgttattgaacccaagtttaagtgtgtgtgtgtgtgtgtgtgtgtgtgtgtgtgtaggcatatgctttttccatcacaaattatcttccaaggtacatgtctctctctccacgttagcaaatgaggtacatttaagggttttcatattctgaggtaataccttcaggaacttggagaagagagtaagattagaaatagtttaaaatctctatatttaaaataaaaaggggagggacttggagaagggctacttcgataaaacctcagtatgaaaacggggaaatctgagagtacaattggctcctagaaggttggttagcaaaaatataatacatttttaaatagaagcaatgataagagcagcagttaaatacattagaaaagataaagtatattaggctatcaggctctcacttccacctatattccccatttaaaaaaatttttcttcagctttttttttttttgagacagggtctcactctgttgcccaggctggagtggtaaacatacacagtgtttgtttatttttaacaaactgccaaactattttccagactgatattcttttcagtaatgtacgagtgatcccatttctccacatttttgctagttatttggtggtagtgtcactattttttatttcagacactctgaaaaatgtgtagttttatctcactgtggtttcaatttatatttgcttgatgtctagtgatatttaatatcttttccatatgtttgtcatttatatatactattcagtaaaatgtctcttcgtgcctttggctcatttcctaattaatttatttttggatttttgcttttgagttttctaagttcttcgtatatagtccctgtttttgcaactgatatgcaaatattttctcccattctgtaccttgtatttcacttcttaagaggatccttttcagatcaaaagttttaattttaacgaagtccaatttatcagtttttcttttttatggattgtgctatttgtgtaaagtgtaaaaagtctttgcctcagtcacaaaattttctcccatatgtttttctaaaatatttgtagttttatgttttatatttgacatttgagataattttgcataagacttaagttgaggctctatttatttacttatatatttatgggtgggctttgtttgttttgcctttagatgtctacttgctcaaacaccactcacttagaaaaaacgcacactatttgttgaaaaggctatagaaatggaaaggctgttaaaattcctccttggaattgctttcacaactttttaaaaaatgagtttgcacatatttgtgcgggtctatttctggaatctctattctattgcattgaactatgcgtctatctctcccccaattccacactgtcttgattactgtagctacataataagccttaatatttagtggagtgattctttccactttattcttctttgtcaagattgtattagctattatcaggcttgtacttttccgtataaatttagaataagctgatccaagtctactaaaaagaccttgctggtattttagtagaaatggcattaaaactatagattaatttggagataattgacatctttaccatgttgagtattccaatccattagcagagtatatctctccatttataagttaattttttatcatgctgtgtttttcaacagtgttttgcattgagattagactgtgttttcatatttctaatatacttacaatgtgctattgtctgctatgcatgtgattacacaaagattgcgaacatagcaaaaggtctaaaattatgatttagaaaagaaagcagattttaaaaacctaaacgactatagctaaatatacaccatatgtgtatgatgttgaaataattttaagtaataagattataattgtttatagagggattgatagagacctgtaatttttcatgaatgcaaaatatattttaattacattaaagtcatgcatcagagtgttttttaattacttttctttagcctacagttttatgatacatgttgtaaaatgaagactggtccttgcttatattgcagtattaacctgtatcataaaacagatgacaaactcttagaactaagagcactaaatttaaaagtgaacaagaaatgaattcttaagtatcttaaaaccctaaaggcatttttaaaaataaatatatattttatttcatcatacattgtggatgtagagtcattggtgagaaatatatcccctgcattataacaatataattattggaaagtataatattcttttaatatctaattcaacatggaataatagattttcagcaaaaggagggagttgcatatatctgacctttattgacaggcctttttgtctccagtaattacccaatctctatgcgattcagtgttcttaaggaaatccaacttttcttgctcttaattatttgtttccacaaaatactagccaaacacatagctattaggtctatgtgaggtggacgtatacatcaaaatttcttcacagccacttaaccaacgtgctaagttttccagaatccaaaacaaatcagtttaagaggtaggtatgcaaagaccctgtaatactctagattttaaaaaagtatccttagttaagtaccatgagaaaatgagctagtttatgtgctatgttaggaacataatagccaaaaaaaaaaaaaaataaataacagttggaatcaggcaccttggtacttcatgagtattttgcaacagtataatagggcctttcagtaatgatgtgcttgcatagaaatacatgaaaattacacaaatttgatatttttagtaactgaatttagtttagttttgtaaactcagaactcaagggtgacgtgcatatgtgcgtggagtgacttacacatacatacacaagcaatcatatgtacaacttgggctcttagaaagtagggcacattgtcaccagttgaattgtcatatgattcctgatttaaatgataagtcgttccaatttcttcaacccttacttcttgagcgaacagtccatatgcaaatcagtatggagtggcaaactttaatctcacgttctagtgagtattttatactaaaaaccaccagatagagtcatgaaaagtagaaattgtttatatatacacaaacgcattttcttaaagtaactatgagtttcatttactttcatcttatactttgttacttcaaagggagaagttactgatttttcttatctccctttatcagccatgtccctggcaagaaatagaattcaacatggatggttcaataaaacagtacaaaggaactactttcagaggtgtgaatgggcttaaagaaaccaaaaggggctatcgaggcacctagagacaacctccagtaggcaattgtgatatacctttcccagccttaccatgcctgaagagtcaagtgaaggaagtaggattttctaaatccagtaagagatagagccatagaggagattcttaacaggatagttagagatataagctgccatggtgggaaataaggcacaaagagagtggaggtcaatgtaaaaggaatgtcccagatctgctctctttctgcctttctgtcttatgtttatgccttccattggccaaaaccaacaggagactactcggcaagggagctaaggaaatgcaatttataggggtcagcttcacagtgacagagcagaacaaaaaagagcataaaatggattgggccaagccagcaagaaaagagtgtactgaaatatttaaaatttagagagaaaaaataaatccaccaacctaaaatgctgtattggtgaaattatccttcaaaagtaaaagagaaatgaatactttatcagacaaacacgctgagggaatttgctgccagtagatctgccttgcaagaaatgtcaaaagaaggacttcagagaaaaagaaaatgatgtaagtcagaaacttagatctacataaagaaaggaagtacattagagaaggaaaaaatgaaagtaaaacaaaattatctattcttcctattcctgattgatctaataaatatttgttcaatataataacagcaagaagaaacattggatgattagagcttatggataagagaaacgaatgccagtaatgttacaaaggttcaagaaggaagagttgggaatattctgtgtgggaaaaaacggattggagtgggagcagaaaaacaaaaatcacaattcctttacgtaaattaacatcagaaccatcctctaattaggagttcaagttcaacttcacttggttgtaatcataatttcaattctttctcttcttaaaagctaaaggagccaggtgcggagtctcacacctgtaatcctagcactttgggaggccgagaggggcagatcacttgaggtcaggagtttgagaccagcatggtcaacatgttgaaaccccttctctactaaaaatacaaaaaattagccgagcatggtggcgggcgcctgcagtcccagctactcaagagactgaggcatgagaatcgcttaaacccagcaggtggaggctgcattttaattatttattcatctgatgatggacagaatctaaaaaagttgaactcatagaaatacagattagaatgaagattaccacagaaatggcggaagggtcctaccgggaaaagaaagatgttgatcaaagggtacgaatttttagttaggtaggaggaagaagctttagtgatctattgtacatgatggtgactataatatatcataatgcatcatatatttcaaaattgctgaaatagtggattttaatattttcaccacaaaaaaaatatgaggtaacagattcattaacctgatttaatcactctgcattgtaagcatatatcaaagcaccatattgtaacctataaatacaaacaaatattaattgtcaatgaaaaagaaatttaaaaataaacgacaacatcaatacgacatatgagactaccattatagtccaaaaagtgcactcctgggcatttatcccagagaaatgaagacttatgttcacacaaatcctgtacattagggttcacagcaattttattagtaacagccccacactgtaaacaacaatatctctcagtcagtgaatggtgaaactgtaggatgtccacaaccataaataaatcagcaacatatattagtaataaaaagtaacaaactattgcaatatgcaacaatttagatggatcattaagcaattatgctggctgaaaaaagctagttcgaaaggattaaataccatacaattctatttgcataatattcttgaaatgacaaaattatagacatgaagaacagattaatggttgccacatgttaggcatgggacagggtgacaagaggaagcttgatgattttattaaaggtcaacaggagagatctttgtggtcatgtaacatccgtattttgactgtcgtggtggacgcactaatctacatgtgtaaaaattgcatttaactaaatatatacacacacatgagtataggtaaaactgggaaaatctgaattagagaggttaattgtaacaaaatcctcattataatgtttgaatataatttgcaagatattacaattggggataaccgagcaaaagccacacaggatatttcacataggatcttttatattattttttacaactgttcttaactctacaactctttgaaaataaaatgtttaacttttaaaaagtttctcaagcttgcttagcttgtgtcagagcttggattccaatgcagatatgaagccagagcccttgcttcctgtcattgctctataccggtcctcagagttcccaggacgcaggaaggtagattggaattgcactgcaggcacaatttaaccaccataacagatatcctaaattatttttttatttttaatttttgtgagtacacaatagatgtacatatttagcggtacataaattctaagctaccaatagattttagatcatatggtcttgtaaaatagtatgagcatgcaacggttaggatcatgctgccaacctctaccacttaatagatgggtgtgtgtgtgtgtttgtgtgtgcgtctatgtgtgtgtgtgtctgtgtgtatttgtgaatgtgtgacaccttggagaagaaaatttttcacacctcagtttccccaattgttaaatgagggataacaactgttgctaactcactgagttacaaatgacttaatatcgacaatgcacttagaataccacccagaacatactaagttgtatgtgttagatattattattactactactgattgcagaaatgataaaatatgaaaaatgttcttttagaagaaatgtggcaaacacactgacatgattcaatgaacagcagtctagattatgtatattgtcttataattttatcatctacgtgacctaagtattagccaccgctgccattccaagagtcgattttttgtaaaattctgggaaaagagattttgcttctcacatttactcctaagtcagaagtctattgggtaatcacttctctgggtttagatccctcctggccactctcagtgattctttcgcccaggccactgttcgctaagcttgtcaccacatggatttactggacaattgtccatttactggacaatggctcttcctagtgtgctgctgcccctcagcatgggcttcagccccacaccaaacatggaacaggctctcctcctgttactactcacccttatagtccccacaactccatcagagagttctgtaggaatactggcctttactggagggttgggattgggggtaactaagagaattacgttaagggatggagaaaggccaaactctatactaacaatggcttggtcttgtgttgtgtagcagaaaagcaggaaaaaattaacccctacacaacgttttttgtgagcacgcaccagttcctattcttactctttcctattgaaggctatgggcttcctttctaaaaggcctccattttcaagctagaaatgactgccttccttcagggaaattccaccccataataggaaacattgatcatttactatatgccaagtattgatctaagcaactcatcagaattaactactgtatttaattgattctgagatgacatttcacattttaacatttctaaaatcaatatgtcttaaaatcattagtgtatagcgtttaggggtatcctgttttttaatttgttagtcctacacacaacaatggtctatcttgcaatttattatttcttagattcaatgacatacagcaatatagttttcacaacagtttaatcatttagggacttattttatcaacattttatagatgtcacaatcgagtctcagaggtgatacacacctagcaacctcaaggttgctcaaggtcacacagctagtcaatggtagatttaatcccagatagcctgatccaagagcctgtacccttagaatataatctgctcctcccagattagcgccatctcccatgggtccccattaattagcaaggacagcctaatctaattcatagtgaggaagagaaacattttccaaagtttgcaaaacttgccaagctggccaacttatattattattattattattatttttttttttttttatgagacggaatctggctcagtcgtccaggctggagtgcagtggcgcgatctcggctcactgcaagctccgcctcccgggttcatgccattctcctgcctctgcctcctgagtagctgggaccacaggcacctgccaccacgcccggctaatttttttgtatttttagtagagatggggtttcaccttgttagccaggatggtctcgatctcatgacctcgtgatccgcccgcctcggcctcccaaagtgctgggattacaggtgtgagccactgcgcctgtccgttatagtattaagcaaaacgagtgccaatatttggcttctccttcctttttttttttctttttttttgacaaagtttccctcttgtcacctaggctggagtgcaatggcgcgatctcggctcactgcaacctcagccttccaggttctagtgattctcctgcctcagcctctcaagtagctgggattacaggcatgcaccaccacacccagctaattgttgtatttttagtacagatggggtttcaccatgttggccaggctggtcttgaactcctgatctcaagtgacccacccaacttggcctcccaaacttctgggattacaggtgtgagccaccgcgtccggactctccttcctctttcaagttgtttcctgggtgtggggtgtggtggggaacagaggcgtaaatagcaggtcctttacagaaccacctaccacaaagatgactacactttgcctacacaaaaagctggcagaagctttttgctttattttggaggccttatcaaacaccagggcagaatgatctgtaatctctgaggtgagaagctagtgaggattaaccacttttctctcctagcaaaaactcccaaatggtgaggctagtggggaaggaccgggtggtagtgttattgttcttccagttacatgtatttgtaatattattcaatgtaccttatctattaattatgtatattttatcagctcattccccatccaactgtgacagagggaagtgtgacacaagaagtagtgattaaatatctcaacatgttcatgcatccagcgagcaaaaacccagactactttgaagtaaggatagactatgtcagccccattaccaaatatttgagggaaacggttgtacaatataaaaccatttctgaattttagaggagtcaaatataaggtttccaaataatataaaacgcacgccattggtttcctccctccctccctccccttcctccctccttccctcccttcctcccttccttccctccctccctccctctttctttttctttctctcttttttttttgaaatggagtttcactcttgttgcccaggctggagtacaatggcgcgatctcggctcactgcaacctgtgccttccaggttcaagcgattcttctgcctcagcctcccaagtagctgagattacaggcgtgtgccaccacgcccggctaattttgtatttttttagtagagacagagtttcaccatgttggtcaggctggacttgaactcctgacctcaagtgatccactcaccttggcttcccaaaatgctgggattacaggcacgagccacagtgccccgccagttatctttctttggctacacctttttgaggtaggactttcataccactgggcaatagcaactgaatataggaatgaacttaatatttctcatacatgaagattatggcatttcatttctatttgtgaagtgggcacggatatattaaaaatatagaaaaccttactgttctcatttaaaattttttcacgatatacatcacatttcatacaaaatgaaaatatgtattgctcgattttgatatatcttgtacttgattgtcaattaaaatgaattaatttttgtattgaaaaatttagtaataaaaactgagaatgtgaactacacacccatatacgtgcacaacaaaagcttaacatggtatctataataagcctacagagttcttttaaactaaacataatagttgccaaaagggattcatagcttttgaattgatttaaaattaacctccctgtcacttccaaatgaatttccatttatgtaacataaaattgtcccatgacaaaactttcagccggaatacatttattccttcttgagtctatcatttgcaaagcactatggtgtgccacttggaaagggatctaaattagaatttttcccaaaagccataaccaggtatatgacatgcagcattttaaagggtactcttgaattcattttgatgcctgtactcacttgagcacatatgttttacaactttgaagacctccctctcttagctgggttctagctcacacaatgctccagcattgaagatgttgaaaaaagatgtgtctgaatattcacacacacacaagtgataatacctacataatactgggttgatggtttattaaaacacaagaagcatctaaactgccccacaaatatcatgcatatttagaaataccagattcattttgcatatcttgtggattccttatacagcaccctctctcccccctgtttgtgtgtgtatgtgtgtgtgtgttaatgtgtgtgtctgtgtgtagatgtgtagaaggaatctagtatttctaaattcacatgataattgtggggcattttagatgctttttgtgattgaataaaccattaacacagtattgtgtaagtagaattattcacattttgcagataagaaaactgagatttagtaagttttttgtccaaagctataaccgagattttaaagtcctgtgacgttaaaccctaaaacatatgcttttagtatcataatctttaccatggttaccagatgacatgttaaaaatctgctaagtaaaggataggacaccaataacccaaattattaaatgctatctaggtttaagtgagggcttccatcaatactgagaaaactttgcctgcatgcacccttgctacttaccaattaacagcatcgccgttatatatgagcttgttaagtaagatgttgaatactggccgggtgtggtggctcacacttgtaatcccagaactttgggaggctgagggggttagatcacttgaggtcaggagttcgagaccagcctggccaacatggtgaaacaccgtctctactaaaaatacaaaaattagctgggtgtggtggtgggcgcctgtaatcccagctactctgggggctgaggcaggagaatcacttgaaccccggaggtggaggttgcagtgagccgagatcccaccactgcactccagccaccactgaactccagcctgggtgacagagcaagactctgtctccaaaaaaaaaaaaaaaaaaaaaaaaaaatgtcgaatgtcaggcacattccaaacctactgaaacagactctaaaatttaacaagaaccccagattatttagacacagttatgtatgcaacagctatattctacaggtgtaacaagaaacaaagctaaggaccaatctaaacatttcctaaggaaaaaaaaggagggcaatacctttacttattcctttattactttcaaaaagattttataatgatttgctaaattctgttcgccctgatcagataatatgtctgcatctaagttaaaaaaatccagaatcaaaatcaaacttgtaaaattcttgttttcaagcttattttttaaatgaacatagagaattgtatgtatttattgtgttcaacatgatggtttgaagtacatatacattgtgatatggttaaatctagctaattaacaaatgcattccctcacatgttatcatttaacatccactctcttagtatttttcatttgaaaaaaattaggttgagcatccctaatccaaaaatacacactctgaaatgctccaaaatctgaaactttttgagcactgaaatgatgtcatacgtggaaaattggacatataagtatttaatgcaaactttttttcaagcacaaaactgctaaaaatactgtataaaattacctcaaagttacgtgtataaagtgcaggaaaacataagtgaatttgtgtttagtcttgggtcccatgcccaagataccttattatgtatatgtaagcattccataaaatcccaaatctgaaacacttcaggtcccaagcattttggataaggaatactcaatccgtatcatcattaactatagtcaccatattgtacaatagatctcttgattttatttctcatatctaactgtaaatatgtattatttaaccgttatcttcataatcctccctctctcttaactacctcaccttctggtaaccaacattttattctctactttaaaatcaaccttttcagattccgcataaagtaagataacgtggtattttttctttctctgcctggcttatttaacttaatatcctccaggttcattcatgttgctgcaaatggcaggtttcattctcttcatggatgaacagtattctattgtgtacgtataccacattttttcttttattcattcaccagttgatggacccttaggttgattccatatctcagcaattgtgaatgtgctgcaataaacttgggtgtgcagatatctcttcaacgtgttgatttcatttcctttcggtatatagccagtagtgggactgctggatcatatgttagttctagttttaatttttttgagaaagcccctactgttttcaataatggttatattaattcacattcccaccaacggtgtgcaagggttcccttttctctaccttctcaggaacacttgttatcttttgccttcttgatgtcattctaacaggtttgagttgatatctcactgtggatttatttacatttacctgatgtttaatgatgctgaacatgttttcgtattcctgttggctatgtgaatgtcttctcttgagaaatgcctgctcagatcttttgctcatttttaattgggttatttgttttcttgctatttatttgtttgagttactgatctattttggctactaaccccttataagatgtatggtgtacaaatatttcatcccattctgtaggttttctcttcactctgttgattctttcctttactgtgcagaactttttgagtttgatgtaatcccatttgtctatatttggttttgtttcctgtgcttttgaggtcatatccagaaaatttttgcccagatcatagtcatggagacttcccttatgtttccttctggtagtcttatagtttcaggtcttacgtttatgcctttaatccattatgagttaatttttgtacatggtctgatataagggtctaattttttctgcatgtggatatctattttttccagcaccatttattgagaagattgttcttttcgcattggatatacctggtaccattgttgaaaatcagctggctataattctgtggatttatttctggcctctgttttattccattggtctatgtgtctgtttttatgccagcaccatctgttttggttaccatagctttgtagtatattttggtgtcaagtagtgtgatgacaccagttttgttctttttgctcaacattattttgggtcttcaagctcttttgtggttccaatttctgtaaaaaatgtcactggtgttttgataaagattgcattgactgtagaaagctttgggtagtgtaggaattttaacaatattaattcttccaatacatgaacacagaatacctttccatttatttgtggcttcttcaattgctttcatcaatgtcttacagtttccaggtctttcacttctttggttaaatttattcctttttttgtgggggcgggtggacagaggacagagtcttgctctgtcgcccagtctggagtgcagtgtcatgatctctgctcactgcaacctctgcctcctggattccagcgattctcatgcctcggccacccaggtagctgggattacaggtgtgtgcctccacattaggctaatttttgtatttttagtagagacagggcttcaccacgttggtcagtctggtttcaaactcctgacctcaggtgatccgccaacctcggcctcccaaagtgatgggattacaggcgtgagccaccgtgcccggccagttcctaagtattttttgtagctattgtaaatgggattttttaaaaatttattttttattttccctaagttattggggtacaggtggtatttgattgcatgactaagttctttagtggtgatttgtgagattttggtgcacccatcacccaagcagtatacacagcaccgtatttgtagtcttttatcccttgcctcccccaactcttctccccaagtccccaaagtccattgtattattcttatgcctttgtgttcttatagcttatctcctacatatcagtgagaacacacgatgtttggttttccattcctgagttacttcacttagaataatagtctccaatctcatccaggtcactgcaaatgctgttaatttcttcctttttgtggccacagttataccacagtttctctttatccactcgttgattgatgggcctttgggttggttccacgattttgcaattgcgctttgtgttgctgtaaacttgtgtgtgcaagtatcttttacatataataacttatttttgtctgggtagatatctggtagtgggattgctgaatcaaatggtagttctacttttagttatttaaggaatctccacactgttttccatagcggttgtatactagtctacatccccaccagcagtgtagaagtgttccctgatcaccacatccatgccaacatctaccgttttttgattttttgattatggccattcttgcaggagtaaggtggtatcacatcgtggttttgatttgcatttccctgatcattagtgatgttgagcattttttcatatgtttgttggccatctgtagatcttctttagggaattgtctattcatatccttagaacactttttgatgggattgtttgtttccttcttactgatttgtttgtgttcattgtagattctggatattagtcctctgtcagatgtatagattgtgaagattttctaccgctctgtgtgttgtctgtttgtttactctgctgactgttccttttgccctgcaaaagctctttagtttcattaggccccagctatttatctttgtttttactgcatttgcttttgggttcttggtcatgaaatccttgcctaagccaatgtctagaagggtttttccaatgttatcttctagaatttttatagtttcaggtctggatttctttttcagatagattgctatgggaatgctactgatatgttgattttgtatcctgcaattttactgaatttgtttattatttctaacagtttttggtggaattttttacaccagtcaaaatggctattattaaaaaacaaataaacaaaaaaatctccacatgttggcaaggatatggagaaaagacaatgcttaaatacggttggtgacaatgtaaattagtacatctatgaaaaatagaatggagatttctctaagaattaaaaatagagctaccatttgatatagtattctcacaactgggtatctacccaaatgaaaagaaataattatattaaaaagatacctcactcatatgtttactgcagcactattcacaatagcaaatatatagaatttacttaagttgattggatgaggaaaatgtggtatatatacacaataaaacattatttagccacaaaaggaataaaatcatgtcttttgcaacaacatggatggaaccggaggccattatcttaagtgaaacaattcagacactgaaagacaaatactgcatgttctcacttacatgtgggagcaaaataatgtgtacatttgaaagtagagtgtggaatgattgacaatggggaatcagaagggtggaggcatgggagggggttgtatgatgagaaattacttaatgtgtacaatgcatattattcaggtgatgaatgccctaaaataaaattacacttgtattccttaaatatatacaaataacatttttaaaaataaaaataggggttctataacattatgtcatcggcacacagggataacttaacttctttttttcctatttggatgccttttgtttattcttcttgcctaattacttccaggactgtgttgaatagaagtggagacagtgagtatcctcgtcttgtgccagatcttagaggaaaagctttcaacttttccccatccagtataattcttgctttattgaagaaaatgccatacttctgtcaaccactggtatagacagctgattatataagttggatcttattaataagtgagaaagtcagcaaaattaaagtgttgctgctttttatataattttaaaggattccgaaaacaatatgattacgataaaatctgaaaaaagtaaatggatatctataccagtttgctcagaactatataaggatggtatcaggttagcttggtcaaatacaagtacataacaaaaaagtaaaataaatatttttaaggctgagttcaactcaagctatttctactctgagtttgcaagtttagttatttgatttcaaatgatccttttgcttggtttgattttccccgaaatggtcaattgtgaataaattgtttgatttgattcgtagttttttaactgagtaggcaaggtctcagatttacttctcttgaagactaataaagaagacattaatatctaacctgtttacaggaacagagtttcttgagcacagctgagcttcccaaatgccatagaaacaaaacgaaatggaagaatttatctggtaggagtgtattttgatgtgacctaatagaattcaatgaagcttcattttataacttgctatacaattaatatatattgacaagccctagtgtcttcaagtcatgcataaaatgcttttgaaacaaattatcagcatttatttgtgagttaaataacttttctaagtgtatcatgagaaatgggttaaacacaactttttggcatattcttcctgctaccacttaaaaaagcacatcatttgtatatttcattttcaaatatgtgacttccttcctgttcatgatttaatccatatttttaaacataaaataagctagcttaacttttattacaacagaagtctgtttatctggagtgaggttttaaatatagacatttttgctccttcagtattgttttaaactaatgcatttcaataagactagtttattatacattgtactgatagttaaagtaactgttaatggctattttttcagggctctgaaaagtaaaaaaaaaaaaagaaaaatcactacccgaaatatcattcttaggaaaaagctgggagttaattggaaagtgaatagaaacactcactctgaatagtcaaaactgatgaaattaataaaactacatatgttgcatttatttatgttctttgttaataatcagtcactaaacctataatttttccattattcacttaccaaaaaataaaaggaaaatttagaaggtgaactagatctattctgtgttgttgtcttgttctgctgaagttatgaatgatttgtgatgaagtccaagtatgggcctcagtctagagaactggctggccaaaacaactatgaattttaacagaattgcatgaagtgctagaatctcagtttaaatgaatgcagtggctacttctaaatagtcagtagactctactttgtatcatagaagtaatacttgtaaatttacaactttgttgatgagttttgcatgattccacatttttaaagaaaaatttgctaaactgaacatatttttgtaatccattaagaacagaatgaaaactgaataacaatatgatctatgttgtacccaaaacctaatgtattttcctgtaaaaaaataaaaatctagcttctgtaactaggaacactacaaaactgaaactgtagactctttaatttcagggttcatgaaggaatttttttccatactgacatgttacattaatactctaggaattaatgttagaagtatttgaactagtattcaatatatgttaatgaaatgtagtacatatccccattggttgtgacctaatcgtttttaaatacgtacattacatttgatagatgctcaattatgaatcctgctttttcaaggtggaatatctgagaaacttgtttcactgatcaaatgtcctgatgtgatattaagatacagtactaaacagcctgaggcagtgagcatttagtctaatctggccagtgcagaacacacctgggcctccctggggttgctgtggtgaccattctgccatctagtcctcagcatcatcagggtcaacaagctaacagtggcaacagagttgtttcatttatacagttccagtgatatcgttgccttcctggctgtgttgtgtttctaatgttgctcctagctctttgccaccatttctaattcttctgctccccaagagtctttgatattatctttagtgtggcccttactgtttaccctagagatagtgaattctgttacttgacaatttaggacactgatgaacagaataaagtataattgtatcaatgtctataagtagccatttaaaaatttatacataagaatcattctctcaggcattaaatgaaattagagaaattatttcatttttggttttttttgcttgtttgtttgttttgttttgtttttttgagatggaatctcgctctgttgcccaggctggagtgtggtggcgcgacctcagctcactgcaacgtccaccttccgggttcaagagactctcctgcctcagcctcctgaatagctgggattacaggcgcacaccaccacccccagctaatttttgtagttttagtagagacggggcttcaccatgcttgtcaggctggtctcgaactcctgacctcatgatctgcccacctcagcttcccaaagtgctggcattacgggcatgagccaccatgcccggccaattatctcggtcttcaaactctgttttagtacttaaacaaagccttaaactgcttcaagaacactgaatgataaatgaattattctacattgaaaatgaacttttatcaattttagttgaatatggtttcttcttccttgagtccagttaaaggtagcttgggagcaatactcaagtcacatcacatgtagttaaacttttatattccgaatcagtcctttaagtaagacagccaggggttgataaactaaccaaaatcctatccgtcacatccattacaagcattacaatgtaacagataacctgaattttcttatatattttgtttcttatattcttaaaatttagtagcaaatacatgttcattcaatttgcctattgaaaatttatcatatttagctttggggaaatatttttaatttttgagattgaaatataaaatactctgttagtacaattcctagaatatatttaacttctgtactccatatgtttagaagaatgagaagtgtattgaaaattgtatcttatagttgttctactataaaaccaattgtaaatatcattcaatggataaattattattatcattgttgttattgttatttaatcccaaattggtctacttaatgtggctaaaatttctcatagactctaattcagaaaatatattttgttttaagttatttgcactaactacttgtgatagatatttaaaaatatatgtgactcatcctgaatagtgattttatgcacagctgtagatgcaaatgaagtatatttattaactaacaaatgctataagcatttttatgttggtaaattaagactgggttgcatgatagttgaatttaattcatagaacacaattatcaactaccctaaaataatttacataactatgacaagttatatcaaaatttactctcaaattaagttggttattcaaaatattcatttttatgtccattctgtataaatacaagtgattgccatactgtaagactcatgctcataatggagaataaataatattttattgtatttatttatttatttacttatttatttttttgagatggagcctcgctctgtggcccaggctggagtgcggtggcgcgatctcagctcactgtaagctccgcctcccgggttcacaccattctcctgcctcagcctccccagtagctgcgactacaggcacccgccaccacgcctgactaattttttgtatttttagtatagacgtggtttcaccgtgttagccaggatggtctcgatctcctgacctcatgatccgcccacctcagcctcccaaagtgctgggattacaggcgtgagccactgcgcctggccgcgagaataaataatattttctaagaaaattaacttttaatttttcacctaaaaatcctaattttccatttttttctatgaggaaattatcattattttatttttgttttaaaaacaagtttcacagataggagtatgttgtgtgctctattttattttttcacccatttttattctcacattttatttttagtaaaactaattgtcatttttttacagaccagaaactctgaaaattagaaagtgacattcatgaatgtagttattaaaaaatactctccatctttcacaggaataaatgttagaagtatgcttatttatggcataattaccagaggaagagaaaattatcctatcaattgaattttatctagaaaatgaaaagtattgttagtaattcctcagtaaatgatacagctatacataataatatataactctaatttagatatgttcttaacgatttgctgaaacaacccagaaatgattgatccagaatcatgagcaaattagataaatcattggcaacaacttaaaaaatcaacaatttgaaaattaaaattatttttggtatatagtatgtgccaagcttagtattaaacataaagccaataaatgcaattcagcatgtgaaaatgtaactttgaattaggaaaattgcagaatgcagagggttgtatttattactctatgtttcttcaatcttgttattgacagaaatttgtatgtatagaaagctgtatgaaaataagtaactttccatacaaagcccaaataaccaccctttattatcgctcaaatttatttatttttatttatttatttttgagatggagttttgctcttgttgcccaggctggagtgcaatggcacaatctcggctcattgcgacctccacctcctgggttcaagccattctcctgcctcagcctccctagtagctgggatgacaggcatctgccaccacacctggctaatttttgtattttcagtagagaccgggtttcaccacgttggccaggctggtctcgaactcctgaccttaggtgatctgcccaccttggcctcccaaagtgctggtattacaggcatgagccaccatgcctggccaattgctctcatttaaattcaaattatgtagcatttatgctccccatatcattattgcatttacttcataagacatacttacataaatttgatttgattgggatattacttacgacattatgttaaagatacattgcactcttggcctgcccatttttaacaacgtaggaaacagctgcaaacactccttactcctgcaaaaatgcaaggaattgaaaataacctatgtccaatcatgttgcacttttgcaaacattccctacctctccccaaatgaagtaacacagttttgaataatttcttcatcatttcttttctttttatatgtttattaaacacacacatattattcctaaagactaaaattttattttcaatatgtttggctttatggagatgatatttaccatgtagtatgttccattcaggtatcaagggatactgtactcagagaatgcaccatctgacatttttattaaatttattggatttaatattgggttttttgaattataatgttggatttatttttttctttggatattatactgctaacattcatcgatattgttttgtgttgttgtggttcttttttcagttctgtataatagcccacatagtagtaaactattcattatatatatatatatatatatatatatcaatgtacacttgtatgtatgtatgtgtgtgtatgtgtgtattagaacagtggtccccaacctttttggcactagggaacagttttgtggaagacaattattccacagacaggggtttgggggaggtgaaaatctgggggtataggggttgtggtttggggttgaaactgttccacctcagctcattaggcattagattcatataaggagcctgcaacttatttccctcacatgcgcagttcacagtagggttggctctcctatgagaatctaatgctgccactgatatgacaggaggcagagctcaggcagtaatgtttgctcaccttctgctcacctcctgctgtgcagctgggttcctaacaggccacagaccagtaccggtccttggcccaggggttggggacccttgtattagaagacacacatatacaaaaccattacaaatcacaaacatatatacatatatacaaacacatatataaatacgtattgtctatttttaattcaaggtaagttttggcaaatagaaagtaatgctttcttaactatcatatttattcaaatatatggaaatttgcctccaaatatcaaatttgttaaacaggtggagaatagaagtaactattcatatcaaaaccatttaaaatataaatataattatcaaaactctactatatattctaaattatatattttttatttgtgcagaggaatgcagttgtaaagaaaataaataaatttatattttgaaatggggcaaaaaagatgtcaaatattgagatataaaaagtagtaccagataaaagatgcatagataaccctaagaatgagaatcacattttatatgtagggctaagccatttcctatatatattttctggctgactaattagcaatggtaaagatcaagttttacatcaatgctttcaaatcatggtgtttattttttctacttgctgagcccgtactttggaattatatattactatattttattgtgtgccctcttgaatgtatttattcatgtagcaaaaataaaaattaattaattaataagataaaggtaattatgtaagattaagaaagtcacagaaacatagaaactgacctaagttagtgcgtactataataaaacctacttatttctttgtctatgtctaaaaatgcatttctttctctatgtctaaaaatgcacaattcaaattccagataaactctagacctgcccatccagtttcctcctctttgtcaacagaactccaattccattcgggtatcaagggagactgtgcacaagcaatgtactcatcccaaagaacaaatcatgattggccaggctaatcatgttgatcctgttctttttctgccagggactgcctggaatggagtgaaattgagatgcctaaaccaatgacagaaaagctacctctgcactccttgctacatgaaataattcaccttttttcccgagctacatttatctggtattcaggtatatagtgttacatgcaatagatatatgaccatcagtgttatatgcagtagatatatgaccaatctagttttttaatataatggtatattggatattttttatactatcaagggattcttctccccagagataccaactgagaaaacctgtggttggcagtgcaggtggcttgtgggccacatcttgagaaaataatgtcttaaaggaattccagtgaaataaataaataaggaaaatatgtttagtttaacttgtgaagaaagcagcaaatgttaatgtgtgaaataagaactttctagttggggatacccttagagctacaatagtttacatttactgaggattcaaacaattccaactgaaatagaaagcaattttatgtcaatacttaaactactcaagcatttagaacatgttactaaaatgttagtatataatctctgaggtagcctataaaaatgtttcagctttctttttacaaatggaaataaatatcttgaagatgaagctagaaacagcgttttctcgtgttcaagaggcatggtattgagaaacaatttacagaatgaaatgagtgaaagaggaagctacagtcagatattttgagatgatttacaggaaagcataaaacaaacaaaaataaaacaaaacaaaaacaaggcagctaccagagagagatactgacagatttttttcttaagtactatctccttttgtcttttagtggggtctatccacctcactcacttcctttagcttaagttgccttccctttaccaaattttgcctcttatcattaacagccacctatctgtcttctctctgctctccacagggctttctttgttccttgaacttgcaaagggacagttaactaatctcattaatggacatgacatttaaaacttgatgttctacattctttgctttaaaacatgtggcattcatgttagccttaggaagaactagtcctccctgagaatgtaggggatttggggttgaatggggggggtgacaggtgactcatcacatcctggagaggatccaatgccacattggtttgcattttgctattcacaagtcactatgataatttcgctacttaaaaaatgatataccatctgaaatttttattaaagcaatatatacatacacacacatttagaagatcatcacacaaataaccatttatttgcttagcttaatgttgcttaggtatttcctcataagggaaaaacccagaatcagtcatttatatttatatttaaaatgtgaaagaaacttcttacatgtttgtatatgacagcaacaatgctaaattttttcttgattcactttagccaataatactttctgttatgatttagttggataattctggattatgagtcagtttgaaatgaggccatgacaaaaataaaatcaaagtaaaactaaaaatatcgaacatcaagagagtatccatctcctaagggtttgaggtgatgagtatcccaattatcctgatttgatcattatacattacataaacacagcaaaatcttatgtgacctcaaaatatgtacaactattatgtatcaataaaaggatccacctcctattgagaaactatacttgaacccattttagtatgtatatgtcaggtacatactgcaaataataattggaactttggtatggaccaagaataatgaatggacatttatctacaggtttatttagacatattagttcttgataacaattgattatgaagacacgaactacttctactaatttaatagaactagagaatcagggaaagacaagctgtatagaatttaaagtggaagaatttattatagagttaaagcttcatccattttattaatgctaaaaatagatacatttatcattatagagtcaaacaaaaaaatttcaatgagtgaattttaatgtactgtagactgtggagatattgaaagtttaactgaagaaaatctgtctagctttacttctcatccattaaatagagcaagtatgcttggcaaaagaatacctaaaaaaatttccagtcccttctctaagtgacaaaattctgatggcctctcgatattttacaacaggtataagcggttatgaagtaaaaatatcaccgtctctgatggtcatctagtctctaatgagggaaaccaataaatccataaatactaatgaaatttttcaaactctaatccccattcttagttatcaatttttgttattttaatagtaatttattcatgtataaaactggaaaatcccatcattaattagcaatagctctttattaatattttaaaatagtttccaaactaaactcttaatatgcctaatgtcatgatccctttaatgagaaactagccattaaaagaaaatagcttatactcatttctatatataagtacatattattttgtaaacagttagcagaaaatttcaccgttaaaaatgaaatattttccatttttgcatttgaatatctgagaatatgttcccgatattcttgccagtttataaacctatattttaacagtactggtaatgcttaattatacacaaatttgctttatttcacatcacaaggctttgtttgtctggagcatacactattgtttacactgtacagttctttttgttacgatttggatgcttttaaaagagattttaaatatttgctctcaggtttattaaaaaacatagacttgaaaaaagatatgatatattcaattataaaaattgtattaacaaattctaaaagtttatcattatcctaaaatttggggtctggggcaaattagagatatgcaaaaatggttagcaaatttttgaatgtgtcttagaaaaaaaattttcacttgcgaccttaggcttttccccctatattttgatatagacttcacaatatagttcttataatagtggggagatacaaaacatttgaaatcaattttaattgacaactttaagatttattatttgatgtgatgattcgaaagaaataaatcagagaaaaaacagcatgctaaaatgtaaatcttatacagactgattgctttggtaaatatataaaataataagagttattaaaacttgtttagaaaaacccaaaatttggacaagattgaggaacaaaggtggttttggataaaggttttgatttcatgagttaaatttttttttcttcttattgcaaaatgtgatggtctattcatatgattttcatatgacaaaagctcctttagtaacctaaaagatatttgaatgattttaagaaatagtttgacataaaatagaacacctcacgtgtgcaattacaccattttattttcttatatattatccttctttatatttgtgcattattttataatgtggagaggttatattacttttgaatatctattatatgtttacacataaacacagagaatgcacagtaagtgatatctatggcactctattgaaagtaaattcttggtgtaacactcttgatcatgaacagatatttaccaactatcaagaaaaacttaagacattgagcaaatgtcattagttaagtcattcaaatcacctcatatttaacaaatctaagtggaagtccaaggggaattccaaataaacatcactgttatactgaatgtagtcaatagagaattattatatcattggagttaaatgaacacatccattacatttctaaataaatgtgggaagtgctttttatcccagacggaataacaatgctaaaggagattgtcatccgtattttataggaaaggtactccagaaatgtttatgttgctaacaatcaaatttactaatattagtcaaacttgaccatataaatcggatttatataatccatatcttaaaattctaacttcttaacaaataccacttgattattttaaaaccatagatgaaaagaacactgagagggaggtttagaagcaggatatatgtatgattttgatgcttcaataactgcaaagccttggacaattcacctctgtgtttccccagatttcatatctgtaaacagactagatgatctctcaaaagaattccacatctaaaactctctttttctgtgtcctgcctttcagtatttttcctttaattgaatcatttattttcttctttgatcttatgcaatgctacaataaaaacaaaaacaaagccaatttgataaaatatcacattctctattagtgatttttgttatctgagctgttacaaaagtggttggatttattccacaaattaggccatccatacctgcctttctgtaatcatatgcatgaagaaagaaaaacttcacaacttgtgtaggagtctaatttttcaatttagtattgacagtctgaccatgggtttgagtgaaagtttagattttgtagatactttggtttcctgataatctcaaaagctcagttatactttataatatttatgtttacaatcaagaaagtctttacatatatttctataataagctataaatattatcaccttctctgaattgtctaattattgtccttctgcatagacaagctagcatgctatacatcatatggataaagccacaaatttcttgccagataattttgaactagtttcaaatattagcaaatatattagggacaatttcatgtcaaaacattgagtagtcatgatataataaagtataatagacaattcctaatgtttaaaaattagtattcaacagtcacagaaagaggaaattatgctttagtttgatggtaacaccatcctagcgtcaagcatggttacatttctcttaatatttttcctagaaaagcgtggcttctagcttatttgattaatacaaatccttcaaaatctttttattctgttctaggatgagaggaaatataacatttatattttaaattaatcataaactatacattaatcttgatttaaaatagaaacctacttttcaaccgagaatgtacacctgtcatctcaaaagaaggtatatttacatattaattttatatttcagatataaacatttattaaattctcattttttgtttcacctgaactaacatgtagttagagaaatacattttagaaaaaattaatagtaagtgtatcttactcaaaataattcactctagattttctcaattattaaatggcaagtgcaatgtttcttctttacagtattatgatattgttactatgcagaccactattcatttttcctgttacttcctataactgagtttcttctttagtattaataaaatgcaacatctatatctcttcagcccctttgtaaacgtgtaacggagtaacacatcttgaacaattctagtcaccattttacgatatgtgcaaaaattcagggactgtaagtataacctacctacaatttttctattttcagaaagccatacttgctcttttggtgtgatcaaggggtttctggagaccgagaagggaaaatgtgtccatttctgagaaacactcactgtaggaaagaaggtgctatttgcatttaatgtaaataccactttcgttccttttaattaaaagagaaacagaaacccttctatattctaaacataaaaaataaaagttttttctcaatatggtagttgattgcaaagaccattctgtatgtagagatggtcctccctccaattttttttagcatcatgctattttcatttagaaaggtcacatgagtcttttgctgaaaccaatgtgattttcctaataagctcaccatgctaagtgatccaacagaattgctctgtttgttaataaggagagtaaatgacattacttgacagaaacgctctttcaatggtggtttattccaagagattaattcatccttacttgtccagtgtcacatatacgttattaaatatgcaatgtagcatccttcttattcaattatgataatttgctgttttattaatacttggaaataaaatatatcactccatccattagtaatcacggtgatgaaactatgtgataccatattagaagcaagtccaaggtattagagatccatgttcaacttctataaaatggtaagttcgataagccattttgcacagttatatttttccaagcttcttgtccttcagatttagttagtggtcaattcactattagaggaatgtaattattttctggttggcactgaggatgagtaagacaaaaatcaccctatcactgaaggtgccatagcctcaaataccctactcactccagctgcatttatatagaggctctcagttgcacaaaagatcaaactgttgtatctaaagatcaagccagaatgcttttcaaacattagatccttcccaaagcaattctttgtgtaaccagtttccaaaaaagtctgaggaaaaatttccattgtttcctatcgttattagactgttgggtcctactgacgtaataaatatacaaatcactattgtttcagcacaatgttttatgcatgacattttaagaactgtacaaaacacaatattaaaattctgaagtgaaaaataatagcattatggctcattacattctatattgtggtagtttgaactgtgagtaactgtactgtcatcctgtcaactcactttaaaagatccgctatattgttttacacaatgtcatttatttcacaggtataactataccaaagtgttccggtttggaaacatagtgtaaatgtttaaaaatattttcacacagttacctgaaaaatacttgcactgaaagctaatcatcagttacagaaccaccaacaaaagttctgctactacaaatagttttgatgaaacaagacaaacaacgtactaaacattttggaataatttttcaatattattattaccttctgatttgttcttagactttaaagattccctaaaatattggtaaatgatgatggaaacctttttctaaaaatattgctttgatggtaaaacgactggcaacaaaatgacagaagatagccctagagatgcctttctccactttatcctagtatgtctttagagccctgatataaatatatatgatattccaagaccctttgctttcatcattttacacagtcactcctacagaagctttcctcataactgtaggatcatctgccgctgatggtttgttcggatcttaattgtcttatgtagtacatactcaattaaaactcatgctggagcaggactgtctagactttggtaactgcttattaaatagttaagatgttgtatgaggagcaagtgacaaattagcaaacatatatgaggctttgaataacagccagagtaataccaggctgaattaattaccatgttaaatatatgcagaatgggaaaataaaatacctgctatgatatggacaaaacttatcttaatatacttgtttgaagatgggcgcttccaaaggaagctcatgagcatatggcgctttactgtgcgtttaaaaaattgtgctaaaaacatgttttgtcctagtaaatgtttttttaaaaatagactttgttttttagaggagttttacgttcacagcaggactaagtggaaggaagagaggtttctcatataccatctagccctacgaacatacagcttcccccaccatcaaaacttcataccacaatggtatgttacaattgatgagcctacattgatacaatgtcagccaaagtccatagattacattaggtttcactcagtgttgtacatgctataggtttgggcaagtattcaacgatgtgtccaccactatagaatcatacaggttgaacatctcaaatctaaaaatctaaaattcaaatgctccaaaattcaaaacttttgaagtgctgataagatgtccaaagcaaatgctcattggagcattttggatttcaaattttcagatttgggatgctcaactggtaagtgtaatgtaaatatttcaaaatcgccccccccccccaaaaaaaaaaaggaaatctgaaacacttctggtcgcaagcatttcggataatatataatcactgccttaaagatcttctgtaatctgtctatacattccacctcctgccgcaacccctggcaaccactgaaaccactcatctgtttactgtgatcatagttttgccatttctagaatgccacatagtcgaaattcaacagtatgtaaccctttcaaattagcttctttcacttagtaatatgcacttacagttcccccatatttgttggtcttttttcatggctttatagctcatttcaaaggtcctgaataatattctattggctgcatgtacctgttcattcattcattcactcacctatggaaggagagcttgattgtttacaagtttggtcaattatgaataattataaatatttgcactcaggtttttgtgtggatatgttttaagcttatctgggtaaataccaaggagtacaattgctagatcatatgataagtgtgtgtttagttttgtgagaaactgccaaattgttttccaaagaggctgtacccttttgcattcccaccagcaatgaaagagattttgttgttacataacctggtcagcatttgatgttgtcagtgttttggattttggccattctaagaggtgcttaacaggtaaatatttttaagtaacaataatgatgctttcttaaaaagattttaaaaaaattcttcaagaatcagcgacacactcctaaaatccaaatactgaacaggagtgcatgttcacattctccagtccagttacttttcagtaacatagacaacagcactgccctactaaaaatcttcaagtgatgtgttctcaaaacatcatcagagaattaaaattagcgaagacaagagaaaaataataacctctgaatcaaatagataccttttaaagggatagtcattactgttacaaaatatagagaagattgtatacttgctattatatttacataaatattattaggaaactcatcaaatgcctcactgagaatttaaaaagtattttgtatcagctttatataaaagcctatcaaaagtgaaatgggattaatttactattacacattcttattcattctgttttcttgctcatcactttatacaattatatatttttaaaaagtacttattgcctttgtattttgtcgatgataggttgtaaggtactgtagtacagaagctgcatctatgcctgtgtgtctcctaaacagtcattgattcaattaatatttgtggacctgttttccagctatcatgctagtttccagaagtatgatcaaaaattacaacaaaagcgatccacacttacacacacaacagcagtcctaattctcaagaacctgtattatagacagtaatatagatacataaaaacaattaaaattcagctttaataagagaaacctctggtgtttggttttatgttaattgtactgtgtcatgatagtatgtgtgtatttttccctaaacataatgatcctagtttgtcttctattagtattttagtagtatatgcctgaatgtgagttttaatttgacattgtaaagtcaataaataacgggagattaaatataaaacatttaaacctcttcagttaagatggcatggaaatttcatgacttgacacttatttaatatatagaagaataagaaagaaaatataaaaaaagaaagagtgttataacacagtaggacttagacacaatcttggcacctccacatatcagacacagtagctgcagtcctgacagactattttccccccatgggtagtggcttcgcatttagattccttcactaagagtccacatgtacaggataaactagaattaagatcactgcttgaagtcacaagttatggcaaaagttcacccagcaatcattcttgaaaagaaaaatgtcttaaaaattttgctgacctgctgcctgagagcctattatgttaggaatctgttacactagagatacgggaagaacacacacacacacacacacacacacacacacacacacacgccatgaaggcagaagcagcccaaaacaaatgaatttgagtactgaatcttcaatatttctaattaattatcaccacaaacagcactccacgtggtagtagactatctgaatctaggcagctattccaggggccagatggggacaacagcaaagtggtggaacagatataataaacacaatgacaataaaagcaaacccttttactctaaatgctccagaaatctgtgaataaataaaggcctaaaaaaggcagaaaaccaccaccaccaccaccaccaccaccaccacaaccacaatgattcaaccatgagttcagtctagatgaaattattctcatatagatgtctgaagaacatttttaaataatatgtttagaattctcaacaataaaattaaaagataaaactcaataaaaagaacaagtagttataaaacaaaagcatgtagaaattaaaataatttcatattgagaagaaaaaagctataaatgttggaaatgaaaaatgtagtaaatgaatcaattttaaagaaataaacagcttaagtatctggattgaacaagaagataaaattagtgaattagaagatactaatgaagaattcatccagaacgtaacacagggaggcaagtaaatgttaaaaataaaatactaaggacataaaagatggacaatattatacgacaataagagttcctaaagaagagaatgaatggaattgcagagaagccagatttaaagataatggctgataattttatagaactgatgatagacaaagggcaaggtttatctaagaaagttttgaagaaaaacaagttagggtgtctggccctaccacatgtcagggctaaatataaatctatggtaattgagacatattatagtactggcacaggaattggcaaatgaagaacagaacaaaaaaagatgcccagaaatactaatgtacatactaatctaatgtacatgtatatactaatctcgatgcaaaacagaggtgacactacaggtgaatagagaaaaggtagacatttaaacaatgatggtaggacagttatttactctaaaataattcacaaaattattcactattcacaaaaaaacccctaaaaattatttccaagtttatttagagaccgatgagtgaaagggaaaaactgtaatacctaaagaattacatgaaaataagaaatagaccaaaagtcaattgaaaaattggcaaaggacatgaacagatgattcagagcaggaaataataaagggtcaatgaatataaaagatacattgatcaaaaaacaaatgagatataatttcatactcatcaaattgataaaaattataaagtgtcaatatctagttgataagaatttgaaaaatgggggatgcatacactactgttggaggcataaattggtaccaccattctaaaatcaagtacggcaaaatgttatattaatattatttttagtcatcctccagttgtttgacatatttcataataataaaatatatacatgtatcaaaatagctcaatttaaattagaaaatgaatatacatgacctatctttaagaactagtctgtatgtttaccatttccatttgaacattttttattcatttctcttatagatcctatatatttaatgtgttcttgcttttgctgttaaaggcaagactggagacttctttaaattacagtgctttatcaacatgcatcattttagattcacaagcatccttaaccagagtcagagagctttttaaaaaatatatatatatatatatagaaaactgctcccttttactttctgtgttatatggattttgagtttcttagttttgagctatggaattttctttctatgggtttattctttttaaaagtagtgctatttagatttccatttatatattgttctttagccccttaagcaaatcatcagacttaagggcaccattcataatactattattacatattattagtcaaatatctataaaaagatgaatatgacaccaagtgatagaatgtcatcagtctctctaaaaataatagtaataaaaatagtaatacaatcatacaagaagttgtttgctcaggttaaatttaatttataccctgaaataataagaattatattgctttgcacgtctgggaaacagaacttacaaaaaagggaaactgactcataaagtacttatattttaaaattatttatctaattctcatttgttcaacaaattgcacaaatatacaagttgaaaacagtataaaaataatcttacacttaagatcttctttcaaatctagtctaaacaagtctactggaagactttggatagtcttctatgttagtactttgcctctgctggatgaaagaacacaggcaatcaacacagttaatgaagaaaaatgtacatattatagtcattgtttggcctgtatatacatattggaacttactctgctaggataaattgcacaaatatacacgccttttctaaaataaatgcactgtcgagtccatggataaagtcctatccttgccagataataattctaaaaacaagaaaccaaaaataaaaaaataaaattttgaaaggaaataaaacttcatgtacctttcaagggagtaggtgacgaagatggtgctagaatgactctcagcctagggtggtgtgtcataagattagaaagatgtgttctaatctctgtaagccaagtggtagttcatcagcaaaaattatcagttcattgttaattcctggtttatttctctttcagtttttaccgcctaaagtcttgtttaaaacttttgactgggccagatttaagattacacatgttgttaaggggcaaggcaggtcctagtttaccctaggattagaatgttaagccaccaaccagcaaaataaccctagggacaaaataaagtcagttggatcagaattgaaactgaggggtctccactcttctttccccaaagaattttctccttcgttatgaatctggaggatatgtattttagtaaagataaaggttttttttttacatatattgattggagggcattcataatcaattttcaaagaaattagcattgaaggaaataaggagcaggttacaatttctttacagtcatagtaggttgtgggagagatgctggactataaactcccatattctgagcttgttatcctggcacagaaattatgatgacattgaaaaaaatattttcataatgtagtccattaaatttcatgtctacattatggaaactcagaggtttatggtcacataagagtgaaagggcaatcaaggagtaaggaaaaattatgcagaaaggagaaaagcaatgatgcttggtgagaacaatcatactaagtgtgagaacaaagatgatgtacctagttcagattttctagtcacttgaaatattactgacctctaaaacttagggggactttaggctgagtccaggaatttttttttccctaaagaactgtagacttggcaagtctatatttagtgtactcactgtttttctgaattttgcctagatcctgactgtcacaggtacagatgaattcaacacacccggagggctcttgttggaaacctgaagaatttccatgaaatctccaaaagtcaaaagatgccattattacaacactctagaggttggcaaactaccttttatttatttatttttttgctacaattgaaaataaaaccaacatgtattgttccataggccccttgtaaatttatttgtataaactgctgagaatttacgttaatgtcttttacttcttctttttgcatttcaattgaaatcctaggaaactttggcaataaaagatccaataagttattgataatttaaaaaatgattccatagcatcaacaaactatattaaattccaatatcccattctatgattcagtcttggcccatgtaaatctgtgatagaaaataagctgaaaataccaatatgggcagaacaaaatacgtaaagataaatctctcaatttttatatcatacgttccaggatatttaatgaaaaacactttgagtcctaagagtccatattaatagaattccacgttaaaactcctgaacttaatataagctttatcagcaacatagctttcagttaacataaaataaatgtaaataacattgacaggtcattttagtactaaatattagtgctttataagcaactaaattatttagtcagctttattccagataagaagacccttggatttattaaattatagattaaatactgatgtgtctgactattcctgagaaacaccgaagccccactatgtctagaatattgatatttactgaggttcatacataagtcgctatgctagtgagagattcaagatgaaactctagctttctctttattaaatcagccttggcctccccttatttttatgtaggtattgatttccttgatttgaagcaaactttcctcttttgagaaaaataaatcacaactcattgctttaccatctctcccacttcttctaccctaaagatagctgacaaggctggcaataaaaaggtagaaaaagtaaagagtcttacaacgtagatgatttttgacccaggaagtacaagtttaatataattaaaagtgcaatgttgaaatcagcaagagtttgtatttttgaattattcaaccccattatgttctctatagaaaaccaaagaaaaataaataaccaaaagagaagctgcaaaagtgtttcattgagtacagcgttcaatacctcgtcaaataggagttaaagatttagtgaaagttgaaagggtggttaacttgaaagaagatagttggaggcaatacaaatatgaattatgatgtttgcaggttttagaagaaagtcttggattttttcatcaaatgacagatgagagacgaagcattttttatttctgtaataaaaagtatgggtggctatactgtcacttaaatatttttaattgcgaagaaacatctcatcaagtaaaaagtagataagaataaacaagacgctaagcatagacagaaagtgtcctattttaatgcagaaaaaagttttcaataaaatccaacatcccttcatgataaaaaccctcaacagactaggcactgaaggaacatacctcaaaataataagaaccatctatgacaaatccatagccaacatcataccgaatgggcaaaagttggaacgattcccactgagaactggaacaaaacaaggatgcccactctcaccagttttattaaacatagtactggaagtcctagccacagcaattaggcaagagaaagaaataaaatgcatccaaatagaaaaagaagtcaaactatcttttttcactgacggtatgattctatacttagaaaacccaaagactccaccaaaaggctactagaactgataaacaattttaacgaggtttcaagatatacaatacataaaaatatatttttatagtaaaacatataaaaattaatagcatttctatacaacaataatgaccaagctgagagtcaaatgaagaacacaatcccatttacaatagccaaagaaaatgaaatacctaggaatacacctaaccaagatgctgaaagatctctgtaaggagtattaaaaaacattgttgaaagaaacacagataaacgaaaaagcattccatgctcattggaagaaacaatataattaaaatggctatactgcacaaaacaacttatagattcaatgctgtccttatcaaactaccaaggtcattcctcacagaattagaaaaaacaattctaaaattcatatgcaaccaaaaaaaaaaataaaagagcgcatatagccgaagccatcctaagcagcaagaacaaaattggaggcatcacactacagtacttcaccctacaataattcacaccacagtacatcacactatagaacttccaactatgctacaagactacagtagccaatacagcataatattggtacagaaacagacatatagaccaatggaacagaatagaaaacacagaaataaagccatacaccttcaaccagccttcgacaaggctggcaaaaacaagcaatggtaaaaggacttcctattcaataaatgatgccaggatcactggctagccatatgcagaagaatgaaacttgatccctaccttttgccatatacaaaaataaactcatggtggattaaagatattaatgtaagacctaaaactacaaatcctagaaacaaacctaggaaatgtccttcttgacattggcattggcaattttttttttttttttgacagagtctcactctgtcgcccaggctggagtacagtggtgtgatctggactcattgcaacctctgcctcctggggtcaaacagttctcctgcctcagcctcccaagtagctgggattacaggcgtctgccaccacacccggctaatttttgtatttttggtagagacagggttttgccacgttggtcaggctgctttcgaactcctggcttcgggtaatccacccaccttggtctcccaaagtgctgggattacaggcatgaggcactgcgcccggccggcaaagaatttttggctaagtccccaaaagtaattgtaacaaaaataaaaattgacaagagggacctaattaaactaaagagcttctgcacagccaaagaaactatcaacaaagtaaacagataatctacagaatgggagaaaatattcacaaactgtgcacctgacaaaagtctaatattaaaaaatggacaaaagacatgaacaaacacttctcaaaggaagacatgcaagcgaccaacaaacatacgaagaaatgctcatcatcattaatcatcagagaaatgaaaagcaaaaccacaatgagataccatctcacaccaaacagaatggctattatttaaaagtcaagaaaggctgagtgcagtggcttgcgcctgtaatcccagcactgtaggaggcttaggcaggaggatcatatgaggccaggagttcaagaccagactggccaaaatggtgaaaccccgactctagtaaaaatacaaaaattagctgggtgtggtggtacacatctgtaatcccagctgctagggaggctgcagcatgagaatcatttgaacccaggaggttgaggtgcagtgagccaggattgccccattgcactccagcctgggtgacaaaaaaaaaaaaaaaaaaaaaatcaaaagataaacgctggtgaggctgtagataaaagggagtgcttatacactgttggttggaatgtaaattatttcagcccccgtggcaagcagtttggagatttctcacagaacttaaaacagatctatcattcaattcagcaatcccattactgagtatatacccaaaggaaaatagatcattttatcaaaaagacacatgcactggtatgttctttgtcacacaattcacaatagcaaaaatatcgaatcaacctaaaagctcatcaatggttgactggataaagaaaatgtagtacatacacaccacggaatcctatgcagccataaaaaagaacaaaatcatgtcctttgcagcgacatggatggagctggaggacattatattaagcgaagtaatgcaagaacagaaaaccaaatgccacatgctctcacttataaatgggaactaaacattgagcacaacggacataaacatgagaacaacagacactgtggactactagagtggggagggaccggcggggaaggagttaaaagctacctattgggtactatgcttactatctgggtgcaatataccgttttaacaaatctgcatgtgtactccctgtatgtaaaataaaagttgaaattaaaaataaaagtgtcctactttaaagaaaacatgccaggcacctattacacagcaagtatcattattcgctcactacaattattttcagattgaggcaagttcatagttaaaaatttaattggggtgatataatacaatgtggtttgtttagtagtagattttattttaatagtgttatatatgacttaagtttatacaatcatcaagagtctgatggggtctctgtaattagccatactttactgcattttatgagtagaattatatgccttagtgatgtttgcaaattcggagttttgcaaagatcttgggacaaataccctggggctcttcagagtctaatatatacgtaaaataaaaggtcataataaataaaatcatatggagcttatatatatgtatatatatataatcacagatttataatgattaccaagtggatcgtagctataagtgatttaacaggggcaatgctttctttactctaccctgatcaacacaatatttgggtttatgtctctagtgagataacgcttatgtttttatcttgatacttttaaaattcccacttcaccttctggtccttatttttttcatatatcatcaatgggtattcaaggaaaagaaaattattgtataagggttgaaaacatcaagaaacaataaatagtcagatttttaaaacattttcccaaactatcttttgagagccaaaattgtagctgtgagtaaagtaaggctgagtttatcctaaagcaatagacaaggaaaaaaaaaaatcagacaaagaatggcaactctatacctctctaccctgagacacacctgagaccaccctaaaaatcaccagggctgagaataggaggcacccactcataaaatgtatctacccactctcatttgcatggctctacgtgggtccttctgcttttgcaataccttgggacatttacaatcaaccccctcacaacagagagttaagtgccttgatttccagacagtggtgagttttagtagggaacgcctcagcttagacacttgagaagaaactagacggcagcaaaatccatcccgttgcacacgtcctcaactaggaaatgttaacaccttccaagattatctaattttatggtcaataattggtcttcagaaaaagagagcaaatataagcaaaatataagggaatagtatataaacaaaaacaatttcaacacaggaagctgaataaactattaatttttagagaaagggtcaacataagatcactgcttttttatgctataaactatatatatggcccccaaacataaatgaatataatcttggctgtatttatttttattgctttaaaaatgaattatttatattatcaacagctgtggctaaagaaaaaagacttttgtcatccaaacaaagaactatttataaccctgatattccaaggtgtatttaaaaaggtgttatttgtggcaatattgtatctattttctcgaagatcttaaaattagcaattactatcaatgaacatttattgaatataaagtaactgtatagcatttgtatctaatgcatttctaattgctaagttacagttccaacattttcatagtgtccaagtgattattttatatatttctttttaaataataaaagtatcataaactttttggaaaaactaaacttcctattttattgctacttattgcctattatttaatcttttatatgttaacatgatcaaaggtgtaaaaaattaatgatccttaattttacctaaaactaaaaaaaaaaaagcaaatatttatcaaatgctgaatattttttaagcactgttagcaattatctatctgtctatcctagaatctccactctgaacactgcattccatgtgatgaaacattagatatgaaaacacaaggctgggcgcggtggctcatgcctgtaattccagcactttgggaggccaaggcaggcagatcacctgaggtcaggagtttcagaccagcctggccaacatggtgaaacctcgtctctactaaaaatataaaaattagccgggtgtgtggcgggtgcctgtaatcccagctacttgggaggctgaggcaggagaattgcttgaaccccagaggcggaggttgtggtgagccgagatagtgccaccacactccagcctgggcgacaaagcgagactctgtctcaaaaaaaaaaccaaaaaaaaaaaaaccaaaaaaaagaaaacacaataagaccattcaatgatttaagttaaaacatgaatagtgaccatgtgagtggcaaagcaaatgtgtgttctttttcatttttattttttttgagacagagtctcactctgttgcccaggctggagtgcagtaatgcaatctcagctcactgcaacctctgcctcctgggttcaagcgattctcctgcctcagcctccctagtagctgggattacaggtgcccaccaccacgcctgactaatttttgtatttttagtagagacagggtttcaccatgttggccaggctggtctcaaactcctgacctcaggtgatccgcctgcctcagtctcccaaagtgctgggattacaggcgtgagcctccatacccagcctccctgatccctttaagatcttttcccccatttttccaatgacatcttatatgcatatacatgagatagaatttgtgttctaaattcaaagaaggaagagttcattggatttggggagaacttggacgatgttgagttggttggtattgatcagagaggaaatgtatttatagagaaatccatgtagagtgaagtaattatcaaggttattttgtgactgatatgaattcaaggggcagtttataattcagtcacatgttaaagaacaaaaaggacgaaagaagaataaagcagatagaatcgtgaaatgggttacattatttgcaccataaagtttaagtaaatcaaattattgggaatattctgagatagagctaaagtctttctcaagagtcatggttgaaaccacatgttgtggaggaactgatggtgattgttgccccattgtgggattcctccctatggtaatgacatcaaaatgaaaaaaaaaaaaaacacacacacacaagaaaatgacgcagattgtaattagaggtggagctgtttatgatctggttatctccacattgttctgggaaagaattgagacattactgggtcaaatcatgtctgtgagacaaaatgaaaggtaaaaatagtgaataaaaagagaaagattagaaacaagctttagtcacttgctcttccttgcggtaggcccttggaatattgacaaatcctaaaataatttaaaaaaaaacagtggattttaatcaccatgagggtaaaaatagtcttgtttaccactgtatttccaacacatagcgtggtatctgaccctccctaaataattattgaattattgattgcacattttagactactatattagcatatcccacctctaagcattaccctgagatgtaactgtgcaatacagcaataaagggtgtcactgtgtcctcagtccaggcctaacacacagttgagctctgaacaacaatgtaacatcaaacagtgaccctgttgtaacatgttctggacttgtctaagctaaagttcaaatatgatacttccaaccctggttataatctctgaatgatgcattttatacatagcaatgacttttttattttttaaaaaagaagcatttaccatgcaagaaaaaggacaacattgcttcaagaatagtaatcagtcagtggcacccatcttaatgagaggatttacatcccattgttttcattttaaatgtcaatgtgcatacatataaacatttagaaaaacaggtttccagtagatcatgttatgtaaaggtcatacagaccttgcaaatattcctgcatctctaactaatctaatccggttcttgacttcaaatatcaaatgatatcccttactgccacccagaattttgaatgtctggtattgagtggtttctaaaagtttgactttttatatttgaagggcccacatgaagccatacgcaattagcatatgctgtattgtggcaagttctgttaacatcagctctttgattgaggaagaacactaactgttgaatcatcaaaacactacagcagtattttacaacctcagttatgcataatgtgaagtaatatgcatggcctgccctctgtaaatatgagaggcaatttgtttggctccacattttattttgctttcaggattatactacttactaacttcaacaaaagcaatataataagaaatattgcctcacaataccacagctctgtccatcaatagcaaaaattctcaatcttagcaccagtgccaggagatgaatctcattatgataattcagtgattgtatacggattcacatttcccagcatacataagagaatacaaaacaaacacaagtaggataagcaatcagataactgaagttttttttgtcaaagatattaaagagtatgttaagaatcatctaatgtcatctccctattactggaaaaaatggaagctcaggatttatataattagctctaggtcacacaggtagtttgatggtaaatcctagagaattctactgttcatatttcttaaacacatattttcttcattatactttatgtattacagtgatattagccactaccaagtcagcactaattataacttgatagatttaaaggtctaagctgaaaatatttagaaaattcatgttgagaatattgagaaataaggtgggatccaaggtggcatgaaaggtcagagtcttagtctgaactagaatgcatgcatgtaaggcacatgctagaaatttgtgagcaaaggaagaagtgagaaaaaaatgaatatttagtaaggttaatttgtaattagtctataggataaggtggagtgtagaaaccattctgccagggagatgaaaattagggaattgcatgtacaaattcattagctaaaataaggttctgttgtttgagtctctcaaaagaaatcacttctcaatagttatgtaaatactgaaatacaactttgaaaataatttttagtactagccatcaaaatttggggcttatgatgtacaaactgtgtgtttcaaacactactgatgggatctgccatcgaggagcccatgactgagattcctggtatgtgctatatctgtatatctgcctcctccaggaagatttgagggcctcagaaactttttccaaacgtttataacaaggatcctaagactattgccttcatagcgaggaagccagcaatgagctggatcctggacagcatgctggcccctgacatgggcaacaaattagatgggccacagaacctaatttctatagccttgactcaccacaggtttatgctctcccgcacaatggcattggggcaagtttatgtctttgtcgtgttgtgctgtttgttttctaagcaaagggcagtctcctatctcatgccaaatttaaaattcaggctgcatgaaatcttagagatttcacttaagcttttgtgcaaattagttggtttgattgaatcagtgtatggtacagcctagtaaatgtcattcttatattcattcaaaagaatacatgcttctacaaatttgctcataaaattagcaatgaatactggtggagagtcacacatgggaaagagaaaacctggctataaatctcagctctaccactgactagctgagttaacacgaactttaagcccttttaactttggcttttctcatctgaaaaatgggcagaaaatgtgggattttgtgaggaatagaattaatactaagcaaaagttcagatccgttttaaatgtcagcaattatttttctatttaaaaaagtatatagcgtatgttcatgtatcactaaaaatcatttctgggacaagctgagacataccataattatgtgtcaacacctgaggtacgtgtaattaatgctagagaaggtcagaagaagggagcttaacattggcaatttgctatttaggaagtgttccaaagaaaaagtgggattgtgatggactatggaactcagattagtaagacttggactaaatgaaagacatcctaatgattcaacaggactaaaattaaatatggaattgagcaaaagagactgagtgttaacatcctagaaaattgggaaaatattggcataatcatttgcccatgggaaagcatatgacatgtacttgcatacacatatattccatatatgcatgcatctctgtgtatgtttacgtacatatacatatcatttgcactcagaaaacactattactaacactacaatcatatatatgtggtgtgactatacaattgtatgattgttttctttgaagttcattaaaatcacatatattacttgcaaatttccgatttatgtacatatgcatacctcttaaaatgggatatatagtattccatctaataaagatgaaatttttgtcaggcttggaattcaagagatcttccttttatgtattatatttttactcaaatggaccactgctagttaagtttctttcaagttttctctgattcggtaaatgccatttgaggagttcattaacatgcgtttaaattcaggttccagtgcatgatgacggtcacatcaggccatggtgaaacaggaaacacatgaagaggctggagtatttttttttaattatttcattttttaattctgtgatcaggtccttccaagttttggtgctgatagggtctttttcttttatattacaatggtgagaagccctaattagcaaagtaagaaaatggcaactcaaggttgatctctggtttgtttctaacttgttttaaatttagttgaatcatgaagtctaaaagtccagagagcacgaaactaagctacattaatttgaacatctgacataagttagactagtatttttcaagttgtattctatagagctccccaattaaattcagcaaaatgatactggtattgtaagtaaaaaagaaagtaacaacctattacatttctttctttgtcaaaaatatgtaatctacgaatcattggggtgagcatcaatattatatacatgggatgaaaatgaatttaatttcattaggatcaggctttaaagatctaaactaaggctgtttgaatttttctttttaatttgataaactacaagttcacaggaagtttcaaaaaattgtatagggaggttgaaggtcctgtgcacccttcacggaggctcactcaatatttacatcttgcaaaactgcggtataatatcaaaagaattgacattggtataatccataaaccttcttctgatttcaccatttatgtacgtatacatttgtgtgtgtatgtgtgtgtgtatatatagttatactcaattttaccacatagatcacttcacgtaagcacaacacaagtggtagatgtaccatcacctcaagacaccccatgttatccttttataggccacctgccaccttcccccaatccatatcacattatgctgagtgaaataaaccagtcacaaggggctgcatacagcatgattccattgacatgaagaccaggtcacccaaatccttagagacagaaagtggtttcgtggttgccaacagctgggtgagggaggagtgtggactaactgataaatggatacagtggtgcctttggggtgatgaaaatattttggaccaaaatagagatgatggttgcacaccatcgtgaatgtacgaaatgctattgaattgtacactttaaaatggttacttttatgttatgtgaattttacctcaatttaaaaaatgcaacctcatggccctctgactgtccatgagagaggccagacttgcagggcagggtctgcagtttcctgagaacccacaagcagacacgtccttatgagatgcatgccctggaaatttctttcacaacgtgtttatgactcctggacattttgggctgaacagtcacaagagaagctagtcatgctcaatcatattttgcttccatggcattttcccaccctcagcctcctactccttttcatagacacacacacaaacacattctgctatatctatggatccagcctctgagccctcaaggtggaggagttcacaagcgggcaaccactcatctatttgccataataatgttacttcagaaatgttacacaaatagagaccagatgcagtggctcacacctgtaatctcagcatttcgagaagtcaaggcgggaggatcgctggagaccagggatcctggtctgtcaccatagtgagaccctgtctacacaaaacaatttttaaaaatgggccaggtgtggtggtgtgtgcctgtagtcccagctattcagaaagctgaggcaggagtattacttgagcccaggacttcaaggctgcagtgagctacaatcgcaccactgcactctagcctgggcaagagtgagaacctgtctcaaaaacaaacaagcaagcaaaaacaaatggaaacatgcaatatacattcattttagattgttgcttttccttttttacatttcaacttttattttacatccagggggtatatatgcaggtttgttacaagagtatattgtgtgatatttaagtctggggtacaactgaagtcatcacccaggtagtgagcatagtacccaataggtagcttttcagcctttgccccttcctccctcccctcgattgtagtccccagagtctactgttctcatctttatgttcatgtgtactcagtgtttagctcccacttataagtgagaacgtgtggtgcttggttttctgtttctgtgttaattcgcttaggataatgtcctccagctccatcaatgttgttgcaaaggatatgatttttttctttttttattgctgcataggatttcatgatgtgtatgtaccatattttcttcagccaatcaaccattgtgggcatgtaggttgatgccacatctttgctattgtgaacagtgctgtaatgaacatcccagtgcatatgatttttggtagaataatctattttcctttgggtataaacccagtaatgagattgctgggtcaaatggtagtccttacttttagttcttcgagaaatctccaaactgcttttcacagtagccgacctaatttacactcccacaaacagtaaagtaaaaaaggacaaagaaggtcactacataatgataaagggtgtaattcaacaagaaaatttaactatcataaatatatatgcacccagcattggcacaccaatgtcctaaatcaagtacttttcaagacctacgaaaacacttaggaagccacacagtaataatgggggacttcaacaacctactgatagtgttagaccgatcactgaggcagaaaactaacaaagaaattctggattaaatttgactcttgaccaactagacctaatagacatctacatactactttacccaaaaccacagaatatacattcttctcatctgcacacagaatgtactgcaagataaaccacatgctcagccataaagcgaatctcaataaatttcgaaaattgaaataaaagcaaacaaattcttggaccacagtggaataaaaatagaaatcaataccaagaggacctctcaaaaccacacaattacatggaaaccaaacaacttgctcctgaatgacttttgggtgaacaacaaaattaagcagagattgttattttttttcactcagtataaattacaccaggtttatccaatagttaattcctttttattgctgggtaatattccatggtatgcatgtaccacagggtttttttttttttaagcaattacatatcaagggacttttttgtgtgttttggtactataaggctgctatgaatatttgtggatacgtttctgtatgaaaacaagttttcatttttttaagaatgattaagagggcaattgctgtgtcatatgctaagtccatttttagtttgaaaatgaactgccaaactattttccagtgtggctataccatttaacagtcccaccagcaatatatgatttacccagtttctccgcttccttgccagcatctggtgtctattttcttattttagccattttgactactaggtaataatatctcactttggttttaatttccattttactaatggttgttgatgttgaacattttttaatgcatttatatatgccatctgtatatcttcattggtgaaacatctgtgcctgtcttttgtccattttcttattggatttttaaaatgttgagttttgagagctctttatgtagttttgatactagttcttgatatctagatatatggtttgccaatattttctcccagtctgtagctcgtatttcatttttttctttttttgagagtgcagtggtatgatctcgactcactgcaacctctgcctcctgggctcaagcgattctcatgcctcagcttcccaagtaggtggtactacaggtgtgcgccactacgcccagctaatttttgtatttttactagagacagagtttcatcatgttggccaggctggtctcgaactcctgagcgtaagcgaccagcttgcctcagcttcccaaagtgatggtattaacaggcacgagccaccacgcccggttatatttcttcttaacagaatattttgcatagcaaaagttttttattttaatgaggttcactttatcaaaatttccttttatggatggcgactttggtgtcaagtctaagaacactttaacgttagatcccaaatatgttctatttttgagtaagttttacagtttaagttcttctgatgtttagatcaaggtgttttttgtttgttttttgcctatgggtgttggattactacaacaccatttattaaaaaggctaaccctccttactggattcctgcttcgtccaaaacaaagggacacaaggaaacttttccagggaattgatgtttgttatttgattgtggtgatggtttcacaggtatatgaatatgtccaaactcatcaaattgtatacattaaatatgtgcagatttttgtatatcaattatactttaagctgtaaaaataaataaattgggcatatttgtggatctatttctgggctctctattctgtttcactgatatatgagtctgtacaccaccagtatcagactgtctagaatactgctgctatataattaactttaacaacagtaagagtgatttctctaattaatttttccttattcaatagttttggctagtataggtcctgtgccattctatacatcctatataatttttataataagcctgtgtaagttcaaaaacattgctaaaattttcgtaagaattgtcttaaaaatagatcaacttagagagaattcacatctttactatggtgagttttccaatccatgaacataatgtatctccatatatttaggtcttctttatttattttactagcacttggtaacttttatcatacagattctgtgcatgttttgttagttttatatgtaagagtttcattttctttgcagaaatcataaatgctattgcattttttttttttttttgagacggagtctcactctgtggtccaggctggagtgcagtggcgcgatctcggttcactgcaacctctctctcccgggttcaagagaccctcatgcctcagcctcctgagtagctgggattacaggcacacaccatcatgcccagctaatttttatatttttagtcgagacagggtttcactatgttggccaggctggtcttgaactcctgacctcaggtgatccggtcgccggggtctcccaaagtgctgggattacgggcatgagccactgcgcctggcctgacttctactttaaaattcttgtcagataatttcaacatctaatttatctaagtgatagcattagtcgatgtcttttctcattctagttttgtttgtttgttttggttctcagtatgcaggcgacttttgatggtactctggacattttgtccattatatatgcagaatctggatcttatttcaatcttttattttagcaggtatttaccatacgtagttcaatacacaggtgccattctacttttatgggctgtggtcccaaagacagttttattttcagagtatttctcgtgttattgaggcctgcttggtttatctagtgatgctggtactctcaaaaatccttgatggtacattctgagtgggcagaaggagttccccagactagggtgctggtgctgctaggtagagtaggggtttcttagatctatagagataaaagtgtttcctagataggattattgtgttagaatccctatactggtaccctccagctgctccaatgtctctgggtaaaagtggagggattctcatggccatagcgtccaacgggcttcccaggctagtcactctttgtggtggatagccttaccagtgctctgtgtttgcccaggtatctctgggtggggaagagaagtcctaggtccatatgaccaaagatgctttctgaaccaggtcacttattatgattgtgtctcttgtaatttctgcctttccacctcgatgtcttcctgtcggaaaagagagcctcagttctgcaggtatgaagaggcttcagtagttaggacacttgtggcaagatctctgtgcctattgggaacagacagtgctttctggatgggattttgttcttgagggatccctcttctagtaccctgtggctgccccagtatctctgtacaatagagggcagcctcagacccacaggaacaaagaggcttcctgcactaggccacttagagtggtaaaatcccttgtggcagttgcacccagccacctaagtatttcctgttgtgagtgagagtgagtgagagtgtcttaggcctgtagggacaaagaggcttccgaggttgggccacttgctgtgacaaaattcctctaaacaatactgccacttgtctatttttcagcagagcatggtagtcctaaatccctgggaaaggagaggcacttaccctagctgcttaatgttagatgggctcccattcaatagcccttgccagttataccaggctcatctggtattgtctgagagactcctattcaattcagagaggaaactagctgggctgccttctgctactaggcttgaaagttggaaaatgacaggtgggggtccccatcttctgttggataggggcacatatgagaatgtgctgcagtttattttcctctagcgcgaggctctcaaagcagtttgcttttctctgactatcctttacaattttcttttgatggcctcttgttttgtttctaggttttattgttcttcttcactatgaggagcagggaaaaatcagtttatgccatcttgtccgaaatggaattctcagtcttgttttaatatgttttaacacgtgattcagataacttggtttttaaaatgtgcacaacttttaaaaagaaatgttccaaaagctaaatatacatttaattgtaccatgctgcgtgtagagtagctggtaactactgaaatcataagtacatgtcagcctttgaaattaataacaaataaaacatcaacttggtcaaatgcggtggctcacgcctgtaatcccagcactttgggaggccaacgtgggtggatcacctgaggtcaggagtttgagaccagcctgaccaacatggtgaaaccccgtctctactaaaaatacaaaaaattagccgagcgtggtggtgggcactcgggaggctgaggcaggagaattgcttgaacccaggaggtggaggttgcagtgagctgagatcgcaccattgtactccagcctgggtgacaaagagcaaaatttggtctcaaagaaaaaaaaaaaaaaacatcaactataccaagtgatgagtagaatgactgtactaggtatgttcgttttcattgtatatttagtatttatttaagcaacctaactaaaaatagtgccgacaataaaaatatctcaatttacagaaatatataaaactttaatatgtagattgtattttattatttaattttatgaaaacatctgtcgaggccaggtgcggtggctcacacctgtaatcccagtactttgggaggccgaggcgggtggatcacaaggtcaggagattgagaccatcctggctaacatggtgaaacctcatctctactaaaaatacaaaaaattagctgggcatggtggcgggcgcctgtagtcccagctactcaggaggctgaggcaggagaatggcgtgaacccgggaggcggaggttgcagtgagccaagatcgcgccactgcactccagcctgggcgacagagaaagactgtctcaaaaaacaagacaaaacaaaacaaatctgtcaaaattatgcaaacaaaaatgtctaccaacttgaaattacagatgagtacatgactataattttatatatatatataaaatacacatataacatatgataaagtattcattaatcatttatgtctctagtttgaacaacacagggagttcaacatgcacctagcacactgcgtaagcctttctatagatgttttagccaagatcaagactgtctattaataagacatctaaaacatttaatcaagcacatttggtttgaatataaaaagatgatagagcaatcaggtttttctcaacaattagtgttttttaacaaaaggacataacagtgcatagccaaaaatttattaatttttggaacttttagtttccaaattcttcttcattaaacacaagataaaaatacttaactttttaagacaggtgaatagaaggaaatttttgctgagcctcttctactttttatgttaaatattttattctatgctttttatcatggcttacacaaaccttcataatgttgctgcaatatatttactgactatcaatgctctcttcaaatttggtataggtatatttttcagcctttcccccttcttgtctccagttacaggcccttttatgggcctataacgttggttttctatctcaattcaaaattcaaaagaaaagactttaaaaatcatctttttttttttgccctaatgcttaatttagagcgtagcacatagatattcccaatatgttctcattaaaggtattgatctttgatttttaaaagtaagtaacaacaaaactgtgagagaggagcagctttttcctttgagaactgtggtttaaatgcagtgaggggtattaatgactacataaatgacttcctatttcagtgaagtgtttaataaggtctttaaaacagtacttcatagcatcctgctcttcaaagcaacatctgtggctctttttggttccaataagtgataaataacaacaggattttggttcacgtaaggacctaaaacaggagagttggttaagctattcatacatgttgctttgtaattgggctgatgtaattttattttattgtgttcaaaatttacactggtattttgtcaattaccttttttctcaacttacaaagtacatttttaaaaaagaaaaccatatacaaagcataggttgtgtaatataatgaaccagtcattattcttcttatctctctatttaaatcatagatttcaaaaagtttaatacgaattcatttgtgtgtgtgtgtgtgtgtgttataatgtagtggagaagcaaacttgatacatttaatgctgtaacattacatattgatgcattcataattcaaagtaacatgatagaaagaaacatacatgtgaaggcattaaaaacatttttgtttgtaaggattttgaaacttggaggatcaaataatataactcagaattctttctgtcaaaataatgtggaacaagaaacacactaaacaagagatatttgggaagttctactcagtccataatttttctcccttctctggcgactatcaccctccagtcaaacaatccataagcagagtccttgatatcatgtttgtattgtgtgatatttgcctctaggacaaggctgactggaccaagattgaggcctgattcaacttggaacaaacagatgcacttcctaaaatactttacctgagactcataaaatgagaatttgtgcaatgagtcattcttagtagcataccactatggagatggcctatggccccatcattcccatggcctgtaggttaaatttttcttgggttctaccagtagataatccagagtatgcacaaatacaccttgaattttgaattgtattttgtttgggtttctgtttcttgcaagaaagaaagacattattgatatttacaagatgacttaaaaatcaggtatattctaaaagaaaagatgagactacttgagataccaaaataaacagggaacaaaaatattaccaacatattatcgtgatgtagataggatttttttcaagaagcttgagagcatattagtattgcatttggtacataatctgaataggaccatacgataaagaacactgtacaatgttccaccaaagtataccttaataacaacaatagcttttataaaaattcttgttttatatatctagaattttacataaatgtaaaaaataatgtagatgttatatctcatttaaatatcaatataaaagttaattggctgatacaaatacatccaacttactcaacttatttattttcttttgagaaaggtaaaattagagaagtccagagacttatacaatgagtacatatctccaggaaatcataattatgaataatctgtcctaatttattgtgcataatctaattataaaagaaaatgattcaaatacatgtgaaaacactttacttccttatctccaggcctgttctcctgctctcgtctttataagaggccatgatatatgaattttatgttcattaatttagctcaattgttctgcttttcacatacattcctatatccataaacaatacataatgttgttgttgtgtatgtatgtgtgtatgttctttacaaatttacttgagtgcttggcatccttcattgagctaatgagctatccataagaatccatgttgatccactccatacccaggtagtatcgctgacaggctgttcagcctctaattgtattatatagctcttcttgcatgcaggtgtggttatttgatttgtttctcccagtagaatatgagtggaagtaatttgtgtcaattcagagcttcagattttaaaaagctaatatatcttctctgctgtttctttcccattctatggatgtatgcagatgactctgaggttgaagagatgcgggggagcaacaaaatggaagacgtctggatccttgcatcgtcacatgcaggaaagcaacacgctgccatggaatgccatggactgtgacatgagcaaacaataaatatctgttgtgttaaggcactgaaattgtgggtttggtttgctatgctagctagcattaaaagaatgaatatactatcacgctttgcaatcgttctacaactttcctttttcactcaatattatatatttgggttacataattattgtgagatatggatctaattaatacagggtttttcaaaagtggcacttttaacgttttggactgataattgtttgttcgggggaggccgtcctttgcattgtaggatgtttgccagaatctctgtcttctacctactagatgccagtacaatgctaccacttccgcagtaattacgataaaaaaaactgcagacattgtcaaatgtcttattcatggccaaactcatgcctggttgagaaccacttatctaatacactctttttagctgcttgatagtatttcaccacaggcatcaaggatatttattatatttttacactattgaacaatgaaaatccttgtaactgattttgagctgaattatgatacccatactagctgcttaagaagaagaaatgccttttcttcaacatcaataaaaagtaaagcataaaattatatagatctgaaaagtaaggaacggttaaaaagacaggagtagaatgtagagcactaggccagtgcaaaaatagaagctgaactctaaactgggacacaatcacaccttagttgttaatttaagtaatggatgcttctgagttaggaatattagctcactcacaccacaatccatcatcaggcaatcctttatgattcttaccttctccaaaacaattcctaccattcaactcatctgcaaagcctgtcagtgctccctgcaaataatacttcatgtgaggctactttctttccttcataagtgccactacccttgtcaaagccaccccgcaaaagtgaaagagcctcctcgaggtgaatggctttccagccttctggaaagctggctgagccactgatgatgatgtggcctttttattctaggtttagtttaaggattataaaaaaccagatatttatataaatattctcttgaatggaagcacatagatgattagttcaaattctttcgaagtggtgatgtaatatcccagttgaacagggtaaggtaaaaataaagattttactttctataactaggcagatctcacattgggcctttagtgtcatgggtgccattccactgggaaatctgatggaccggggaagccatatttccgaataggttatctgttcctatttatgtggtcatccagtttttgaaattttttaactaaatcaattgcaaacttcatctaaccttattgtatagataaacacaatttacttcggccaacctgtacccaacataaaactctgtatctcctgagatcttgccctctctatattcttctcactgcaaacagcatcagagtaatgcccaagtgtacatcccattgtgacatcccctcaaattgttcaatggcctcctattgaccttaggatgaagttaaaacactctagattcacaggtgtcccgtcaaactttcctgcctcatttcatggctccacagatgctggcctctatcatttccctaagttcgctaattcttcgaagcttaagagccattgtacatgttatttctctgtactgaatgtcttccccttctctctccctccaatttttatagttcagaggatctcagcgtaaatatcacctttccagaaaggtcattagaacattaaggattgtaaccaagagacaatagctgttggttttattttttattcttgtggcatatgccaactaacttgcacagtgcctaaagtcgaaaagggctcagttactatagacacaagcaaatatgacctgagctaccaacaaaattacatccgaagacaacaggaagacgagactgtgaggtttccaagtttatagacaaggtcagacaaggaagtcattaggctcgtctctgtcaattttgaacaacaaagttattatttctatcttgcaacaacaaaatatagtttttttaattaaaaaaatcttcatttaagaaattgctgcaggaaaataactttgaattgcaagtataaagaaaattttctgagccctagatgctctttttttcctttgaaaaccattattttcaaaggaaattgttttaaaacataattttttaaaataaggtgtaaacgctcattcacagaagagccctaagtcatgctacaataaagatgtaagtagaatatgggatttgagtcattttttcaatccaaggaaaatttcagaacaaaatatttttggaggtgtccaatatttgtttagtttcacacagaaagacactatttacattcaatatattttaaaaactgtacacatgttctataagattatcaataccaatttactcatttttcaaaaactattttttaagtgtttgtttgacaataagaaaattcttttaggtggtgtttcaaggaaggccacacattttaacataattctaagttgaggtgaattcataatataagacattttgatatctgtcaacaaagactctttacttgaagaacagtcattcaaggtctgtgtccttaaatataacattccagatagcttttaatttcaagtcttttatttccaaaagattttctgtggattatctattatagttactaacaaaataataattcacaccaggcaattatatcctggtatttgataaaacttggatgtttaccatttcaagaatgatttcctgaaaaagaaaaagaaaacagctgatattcaaagtcagccattttctgcagaatgagcaattatttaaaaggaaataacttttaaatgagcgcatatattccaggcacatattttctgctgcttactgaacaagtccacttcaaacataacatgacatgaataaaaaacaaaagaaaacaaaacgaattccaccccaaatgtgctcctccttatatatttctcaccttggtaaatggaactactatttattaaacttctcttgtcagaactttgtatcatttaagatttctgtcttcctcaccttcatttaatcaagcttcaagacacgtagattctaccactaaaaagtgtttttaaacagtgtctattgttactattctaatcaaaatcatattacacttatgactttataagtactacgacctcctactggtctttcatctttcctcagcctgttgatcctccaatccctatataagtacctctattcccaataaagtctctctgccacatgaactcacaatgagctttaaaaagataaagatgatgatgttattccgtttgactaaatctcataagcggctccttatttttttggttataaaatccagaatgctaaacacgaactataggatgctgcatgaggtaatccctgtttacatatctcccccaacccatgttgattcattcatctttcctcattctagctgtgcttgactttagttcctcaaatatacttgcttctttatgtctcaggtctttaatacatgcatgctatacaagccagaaaacatcttaccaccaccctcaagtaatataaactagacaagtgcatacaatgtctttaattcctggtcaatttttatcttcaagtgaactttactataagtgaaagcttttgtttgcttgatttatacatggtcacaaaataagctgccagaaagtcgaatttctttcctcctagcttaaaaatacatctacccctccttcatccttaaaaaagaaaatgcatcttcataaaaagattacaacttttgaatataaaagtcatgtttttcaaacaacggatatattctcaacatatatgtatttcccaccaattatgagacacaacaaaaaaagaaaatttcaggccaatatccctgatgaacatcaatgcaaaaatcctcaataaaatactggcaaactgaatccagcagcacatcaaaaagcttacccaccacgattaagtcgacttcatccctgggaagcaaggctggttcaacacatgcaaatcaataaacataatccagcacataaacagcaccaatgacaaaaactacgattatctcaatagatgcagaaaaggccttcgataaaattcaacaccccttcatgctaaaaactcttaataaactaggtattgttggagtatatcttaaaacaataagagctatttatgacaaacccacagacaatatcatagtgaatgggcaaaagctggaagcattcactttgaaaacccgcacaagacaaggatgccctcgctcaccactcctattcaacatagtattggaagttctggccagggcaatcaggcaagagaaagaaataaagggtattcaaataggaagtcaaattgtctctgtttgcagatgacatggctgccatttatccccatgtaatgccttctaatcacactgatgttctcgttattttgtcttgaattaaaaagtctttttattataataattattatttcactggaaaaagctacatataaataaaaagagaaatacttataattttattgccaagagatagacacccaatttatttgaagactatttccaaacgacagttttttctgtgtctccgtcttcatctttcccacattctgcttcgatatatgttaccctaaaaatcctactacatatattgttttgtaactcacttgtaatatttttcaatagtttctggccatgtttctacttttatatactgaaacaattcaataatttgatggctgcataatttgctattttataaatcttatataatttatttgaccacacttgtattagggaataagatgtaacccatttgtatattcatgcaaattatatatgccaattttaacatttaatacacattgtccacattatctcaagcaaatttataagaatgtatgtattccactactaatactgcacaagactttctattttcatcaatcttaggagtaattaccacggtgggtttgttttcattcccttccccaaaacttccgtaacaatctttggggttttgtcacatctcccttcacacctacatcacctttaaaaccaagagttaggactcattttggaatcatttttttatacagctcaaagtcagttacattatatttagtaccattagaagatacaaattttcctcaacactttctgggtgttggaacctcaaaactattttaaaagagtagcgaagataatatctatgttgaaatgaataaaatagatctatcatgaatatcatgttttataaaacagaaatgtatcaatgaaagatcataagttaacactttaaaatatatgttatttataaacagatatacatattcggaagatcttcaaagtagtacattgattcttatccaaatttgatttgagagctactggttttaaatttgtaatacaaattacgatggggtgcggatttcctaggccagttttttatgtacaattgaatgtagaaaatctacaaaaaaatagtaggatacaatcctggattttggattctggagacagtggaccacattgtataggtgattgaatgaatgaaatgagaagatatatagatgaagaaaaaaaagaaagaaaatatacaaaggaggagatgattggaggaaaaacagatgccaggacaagattctgaagtatatatttttggttttgcttttatccctcacctattaaaccctgtttcatttgactcctactctattttctaacctcatctcccattgttgctcttaccattgccctctctactccaaccacacaagtcaatttttctgcttctctttttttagtccattcctccctttgtgcttcctgtttccctatatagaattctgttatccagatcatcacatgtataggtctgtctattatctcatgtatcagctcagctatcactgcttcatagtggccttcccttttctttgaattgagaagcccttaaatccagattcactcactataggttatgtgattatccctcaaaatcatattctttaaatatttgatttttatcttttctcactagtaagtatgctctgtgaaaaccaggcgatgtctctttttcaccctagacctgtcagtgcctaatatagtaccttggctatagcaggttgtcagtgactcttgcattcattgagattagaactgagctacaagtgacagaaaatccaaaataaccaatatcaggaacaatggaagtttgcatctttctgaaataagaagagacagttgagaggcagtacagtggctccatgatcatcagggacattggacaatttatattattagtttgtcttcttcaacatacaacttccattttgtagtccagatggctattcaagctccaatcatcacattgccatccaagtaacagtgagaaataacaaggaagataggggaagatggacttctcttcctagaagtttcacacattaattcttattatgtcctatcagaaccaggtcacatgatcatacctagctgcaatggaggatgaaaaatttaaactttattgtaggatgttcatttaagccctctctcgatacctgcctctaggctaaacatataaaaggaacccgtttctcactaactcaccccaaaccaataattcatagtgtagctaatattaagtatgtgtccaaaaggtagataactgcccaaacgttttatattcttcctcaccaagaggtaaagggtcaacttcattcttctgcatgtgaatctcaagttttctcagcaccgtttgtttaaaagatgattctttctcattttcatggtcttagcctctccctcatttatgagaggaaggatctgcgctaggtgtggtagctcaggagatacagaagcagccacatctcttcagctatgaccagacgtggtgataagccacagcagcttctgctgataagtaaaaagaagaagagaatcacgtagaagaagcaccctgtttttggccatgtctatccagagtaaagtttctgtcacacagagctagagagagtggggttggggtggggattgttgctcaaatgtcattaactttcactgttctgactgagattttgcaggtttttttgttttgaataaatatttctccatttgctatatgctcttaagaccatttccagagactttccatggttattttattacaattttcaccagttacagttgttttactcgggacagcatccatggagcccctgacactacacactaccatttcagaagtgtttctctccaaaatgttcatgtttatatttcgccatagttttttagttaatatttcacaaacttgtaaaatgtgagtatcttcaccccaaccttcaggactgcagtggcagaggccatgaataggaggtagagtagattgatttagttttaatttagaaaaatgaactcatataagtaacaattgcaggtaaaaattaggatttagactttgcatttgtaggctctgttttcttatatttattaagtttaatatatttgatactaggtagtaaaatgtttactaccgaaaaaaaaaacttttgccaaaatgtgtcaaattttttattttatagcaaatactcttctagttaacatatattttatcttcagtgcccagttatttcagcttcattaagagaaaaaaaaaagggaatcaaagagtaatatagtgcctttttgattttaagactagctcttattacccttggcaatagattatagaaatcatacaagcagtatatacaatttcaaagtcacacacaaaagtatattcttgaattatttaaaaagtttcaactcacaaatattcactgtagaaacatacaaaacatcgagaatttaaaggacatatgaaaacaaccagaaaagagttaaagcatggattacgtttagttttacaatgaaaagcaacagagactttgaaattaaagatttactatggattgtgaaagctgaatgctaaatcttaaggaattttgagggcatactattaaacatagcccttgttaaaattaaataaacttatgattaaataaattatattaaagcaactgtaataaatgttcaaaactcatcacttcttaattattttactacatttcactgtcgtctacacttgtgaggttatttgtatccttttatctgtatggtgaaaatgctatataataattggccactacctatctcatcccagctccacactcagcaacatcatgttgatagcttgaaactggatgtggttgaagtatttacaccacagaaataagcaaacactaagaatcatagcttgagttctttctcactgagctggtggttaaaatatacctacacagtacacatccccaaagagacatatatagagagatacagacataagtatatataatataaatatatggagataaagataaatacaaatagtgacatagatatgtaaattcagctagctatatcagcaaggtaaatgagtaaaaactgaaaattcgtcagcaactcaagttatatttttagtaaaaataaagccttgttctaaacaaattcagaaacaaacacagagactaaccagtgacaactggttatgcaataaacatcctgacaattgcggtgtgcaataaacagacccacatctaccattatttccacagggatgttgtaaatccattcactggccaaacatttactgagttattgactactccctatcagtttctgtgctatctagataaaacagtgagtgacaaatagtggctatccttagggagctaaaattacacaaatggacacagaattctatcaaccgtatgacaagagacatccatgggggatgagctaatatgtgatgacaaactattttgtgacaaatatgatactaaaatatttatttgcattatctcacatatattctatatgaattctgatatgtaactatcatttcttcattttacctatgagatccaggtaagttaaatcatatcacattatttagattctatatccaatcagctgttgacttttatccatgtctttcatagctttattggcttttctcctagtaatgctttctcttgtgaaaggtattccatataattattaaagcaaggttattccaagttaaagtaatccattgtggtgatgtctcccacatgaaacatcactgtctgaatggagcaaactaaaaaataaataataaaaggcagctttttaaatttaggtgacagagcacaagcagattctataaattatagcagtttcataaaaggtaaaatcccaagaaaacctctcagaactattcacatttttgaatttatgtcttctagggtacactgtaggatgtagttaaagaagaaaaaagaaaaaaataagaggtttttcaatataatatgaattccagttttatcatgataggagaatatagactgtaggaagtataatggtaccagatgcttttatttgtcaattattactaaattttagaaaaaagaaaaattctagtttttgagtcttccagactgagcacccatttgacatacaatttaacttaccaaaatatgatagctacgttatgaagctagacacaatgatatgtttcaaatgtataataatcagaaatatcccattatttggttttatataacatatacatagcccatatgtcaaaggaagacacaaaaaatagttttagtacctggttgaaatttttgattaaaaaatttagctgatccttgagaaatttaactgaatctaaacttattcacaaaagcttacattcactttggcttatttgatgtttagaaaattattttaatgattttattcttgcagcatttgctgaatagtgttattgttaagaataacacctctgaagtgatacttcctgagatccaatacacttactgttttagataacttacgctgtagttttcatctctgtagatgaggtgggatacactaatacctacttatcaagcagtctgacaagttttaagaattattatgtccaaattaaatttaaaccaaattaatagtatatgccaaattgtgaatgtacacacacacattagtgtacataattatctttttttccaaaaatatttaagtaaaagaacataaagtttaaaaatagactttgatagtagacagactttttttttgatgaattggtaatattcattcttgttctataattttaaataaaaagtttgtctcattgtatctttaaaaatacgtgttggtgaggatttggagaaaaggaaaccctcatgcactgtttgtgggaatgtaaattggtacagccattacaaaaaaaatagtagggaggtttctcaaactattaaaaatagaattaccatgagatctagcaatttcactgttgattatttacctgaagaacatgaaattagtatctcaaaaatatatctgtactctgacatttattgctgcattattcacaatagccaagatatagccacaacctgtgtttgtggatgtatggatgaataaagaaattatggtatgtatacaatgaaatattattcagccataaaaagaaggaaatcttgcgatttgcaacaaggtgaacttggaggacatatgctatgtgaaataagggcagaaaaaaatgaaagacaaatgttgcatgatattatgtgtggaatataaaatgttgaacttatagaagtagggagtagaatagcggttgccaggagtggtataaatggggagttgttggtcagagagtaggaaccttcagttatagagatctaacgtacagcatggtaactgtagttaatattaatgtcctttatacttgaaacttgctgagggagtagatcataagtgttctcatcacaaaaaaaagagactactatgcccggtgatggatatgttaattatatcaaaataccgtgttgtatatcttaaatatatagaatgtttttatttctcaataatacctccataaaaattaacaacaaaaaagtatccctaaatgatttcaataacatatcattacagcagctacaaaaaggacaaactgatatttagccacaagcatgtgatgatcaactgattttcactattaagttactgttctcttaccgtaagaggaaaatagttccttcatgttttaataatcccatttcatccagaaacacagagataattccctgtgttagccgcacatatctcaattcttactcaaaatttaattaatcttcagtgatggaaaacaatttccttctattaagaccatatcattgctgaacgtctttaatttcaagaaccattaacaaaatttcaaacaatttatgttatttaaaatagaagctgaaaaaaggagaaaactacacaaatattttaccatcacaacaaatgtgaatcacagattcaatatgtgattcttaaacacatttcttaaatatgtttgctgttttggctgcaaaacaatcgtcaatgttgagcgtatcggacactttaggaaaatctttagtaataacaaattctattctcttagtatcttatttcttgctgatactctgtgcctatcctaataagcaggggatggctacatactgtaatcactcaggaagataaaacagccaacattttgagtgttgttggtctcaggaagataaagcagccaacttttgagtgttgttggttgataggtctgagagaaaacagaacacagtaaaacattcaatggctcttagaacatctgtccaaaagtgacacagttcacttcttcgcacatttcattgatccggcatgtcacacagccagactcaacttcaagtgagtgcggaagtgattccacgtaccagaaaggggacagaagcggaacagctatcaagagtcttaatgtctaccacctccacctgtatcagataaccacaacttcacagaatatatttcataataggtacagagaatacataacttaaatgaaactcatcattattaaaaataaactttccaaatattttctctatttattttaaatgtaattaaatctttataagcaaggtctgcaaatttttattctaatttttttttcctgagagtaagtggttattatgttactctatagttgaaaaccaaaatgagagaaaagaaaaatgacataatcagagttagagagatataggtaaaaaccctgactttttcttttggtacttgtaggactttgcagaagacttttgatctgaatggcagtaagtttcctcaggaaaatgaaattaatatcatctaccttaaataggtggttatagtgattacatgagctaatgtttatacaaatgctgtcttttactccttcccttcttagcttctatttgaaaaaactttggtaaggagctgcagcttttcaaaggggccataaacttgactccgtgcagattctaaggaaggcctagtgaggaaagatgggctaggtagttgcttcagttctctaaattatgtgcaagaatcttaaaatgaaatatgcaagaaagatacagtctaggggtggacaggtaaagaacagggagaggtaaaggcaagaatatttggctgaataatggaatatgtttttctagccattctgacaattggtagatgttttacattgtccttttttacatactgctgatattttcgactttaacttttcctccatgccatttttacaattacagtttgaataaattttaataatataaaagtctcttcttgaattttgactctctccactttcccattcaccttgatgtttccgatgatcctttaactgtggtagcagttgcacttaaatagcatgctgcaaatcctacagtgtgagagctctttctttctttatgttaaatttctaaactgtatccactagagacagctcagaagagacaatgaatactaatcaaaagagaaagaatcacttggttgtggtcacgccttagcaagaaacccctttaccagaaaagacaactgttttacatgctacctatatattcccagtggaaacagccacttcacaacgactttaaagtgaagatgaatgagttttatcattgcttttttgtggtgcataaactagacctgaaactatccagtattttatgattgttgcattgaacatgcaaattagcaaatattagctttgatcaaataccacagccacacccagaatgcttgtactagtttaaagccatcattggcaaaggccagaattctttgtttttaatgaagaacatataattcccataaaggcatgagattatcaggcacccatgtcaatatgatcaggtgaaaacttctggttcatcctcaactaaccttttcctatcttgctgatgaggaaaatttaatactaagctaactgtggagacaaactataactctttgtaatgtttggatgccatactgtgattgtttgtgtcttctcaaacttcatatgttgaattctaatcaccaagatgactatattataaggtagtgcctttgggaatttattgggtcatgagggctctaccttcatgaatgggattaatgcccttataagagaggcccaagaggccttggaagctcagtgagcgtgcctgcaccttgaccttgaacttccccgcctccataactgggagaaataaatttctgttctttataagccaccctgtttatggtatttttgttacaccagtctaaaaggactaagacactgatttggggaagattttggcagtaattgctgtctcttttacatactcttccccaatgtaaacttctataatctaatcaagggagtttaaacataatagccatgtaacagacacagtgtaaaatatcaaagattttttaagatgtagaaccagtcgcgttagtattgtggcttcagggacaatgtatttcttatagcaaagagaccaattaacaaggttcgataaagcagtatccatgcactcgctgtccttcagtattttgcatgaagccaaaggcagaatatgctagaagtagaaaagcaggaggttaaaataaccattatcaccaggaccctgacaccactcaaggccaggcattgtctgatttagggagaagcatgagtttccttccaagtggtattacctgtaaaaaccagggcaattcactctccaggtaaggccttaggaactgtacgtacacatttttccatctcaattttgcaagcacctcttcaaaatagtgtgtggataccctgcccactccaaacagacagaaataggtggctctctacataatgcttagaaattatacttcatggtatatttttttttaaggaagacatgccaagcataatgatcttatgcccttgtgaaactttttaaaattgtgaacacagtgtatctcattccaattcgattttacaaaattatgcagtaagttttttccctttgttgtaagaaaatatttgtgtcttagtccactggcgccattataacaaaatatctgagacaggtaatttataaacaacagaaattaattgttcgcagttctgtaggctggtgaggtgtctggtgaggacccagtctctgcttcgaagatgatgccttgaacgttgcatcctccagagagaagggatgctgtgtcctcccatagtggaagtgatggaaaaatataagagcctagttagttctcggttctcaccagcctttttataaggtcattaatcccattcattagggctctgccctcatgatttaatcacctcctaatgtcctccaccttttagtactatcatattggcaattaagtttcaacatatgaattatgtaggacacattcagatcatagcagtttgtaagataaaatacatacatgacacatttcatcatgtaagatattaagttttaatattttgaaaaattttattttaatattcatttttctacacacatatttcatagtattaaacatattggctatatatttttataatgtgatcaatttttattcatcttactaaatattcttgaaaacataattttaataagtgcttaatgttccgttgcaacagatatgccaagatttgtttatctgacccttatttttcagctacttaggttgctggtcatttccacttttcttaaaagtaacatagcaaagaataaccttgtccatactatttaatcatgtctttagggaagagtctcagaagacaaattgctgggtcatagggtcaaatacactctttatgcatattgccaaaatgctttcaaaaaccattagactgatttataacctcaccaacaagaaagggcatgcccacttcactgactcttctactgtattcaccatttctaggttgataggtaaaatttacataaaaataaatttaaaattaaaaactactgatttagttattctactaattccgtgagcatatcttcatatttcttgggcatttatatttcttttgcggtaagctatttgttctctttactctttccatttttctatagtggtattagtagtgttgcacattttttaaagaacttaatttttctagagtagtattagcgtcacagcaaaattgagaggaaggtacagagatttctcatatatcccctgcctccacacacgtacagccacccacgctatctacatctcccaccagacgggtacatttgttacaattgatgaacctatattgacaaatcattatcaccaaaattccatagttaagagtaaaggttcattcttgggtgttgtgcattctatggatttggacaaatatataatgaaatgtattcacaattatagcatcattacagagaatttccctgtcctaaaattcctctggactctacgtattcatacatttccctcacagcccctggaaaacactgatcttttaactgtctacatagtttttgctttcccagaatgtcgtattgttgaaatcatatagtatgtagattttttcagatttgcttgttcactggtttcctctatgtgtttttcatggctcagtagctcatttctttttagcaatgaataacatcttattgtctgaatgttctacatcttatttatccattcacctactgaaggacatcttggttgcttccaaattttggcaatgatgaataaagctgtcataaacatccatgtgcagggttttgtgtggacataattttcaactcctttggtattttacattttaaaattttaagttatgtggtatatataacaagccaaaataagcttagtttcagttaagaattatggttttaaaatcttctaagattaaaatgataaaataaagccaacattcttctttccaccgaagagacttacatataatacaaattcagaagttttatgtctcctagattacacaaatcctgggtaataggaatatgggatgggaagaattacaaatggattatgtagatacttactgatatggtttgtctgtgtccccacccaaatttcatcttgtagttcccataatccccctgtgtggtgggagagacccagtgggagataactgaatcatgggggtggtttccccatgctattcttgtgatagcaagtaagttctcatgagatctgatggttttataagggacttccccctttgcttggctctcattcttctccttgctgccgccatgtgatgaggatgtgtttgcttccccttctgccatgattgtaagtttcctgaggcctccccagccaggctgaactgtgagtcaattaaacctctttcctttatgaattatgcattattgggtatttctttatagcagtgtgagaatgaactaatacacttaattttttaaatgtctgaatatttatcatttcaaatttatttaatgtcttttgtttcctctcttaatataattttatcaacaaatttttccattaaatcagtgaatcttctgaagttatttattataaatatgaattaattcctttcaaatttattaatgaattttaatataatttaatatatgatgtaaaatgatgttatattttagatttgcttgtaacggtcaccaatatgtaaacagattctctctccaacaattagaaatctaaactatactacaaggctacagtaaccaaaacagcatggtactggtaccaaaacagagatacagatcaatggaacagaacagagccctcagaaataatgctgcatatctacaactatctgatctttgacaaacctgagaaaaacaagcaatggggaaaggattccctatttaataaatggtgctgggaaaactggctagccatatggagaaagctgaaactggatcccttcctcacaccttatacaaaaattaattcaagatggattaaagacttaaacgttagacctaaaaccataaaaaccctagaagaaaacctaggcattaccattcaggacataggcataggcaaggacttcatgtctaaaacaccaaaagcaatggcaacaaaagccaaaattgacaaatgggatctcatcaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggcgggactgtaaactagttcaaccattgtggaagtcagtgtggcgattcctcagggatctagaactagaaataccatttgacacagccatcccattactgggtatatacccaaaggactataaatcatgctgctataaagacacatgcacacgtatgttcattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagcaaaccattgcaaggacaaaaaaccaaacaccgcatgttctcactcataggtgggaactgaacaatgagaacacatggacgcaggaaggggaacatcacactccggggactgttgtggggtggggggaggggggagggatagcattaggagatatacctaatgctaaatgacgagttaatgggtgcagcacaccagcatggcacatgtatacatacgtaactaacctgcacattgtgcacatgtaccctaaaacttagagtataataataataaaatttaaaaaaaatgccaaatataacttcaaaaaaaaaaaaaagaaatctatacctaatttaggagacaaaacaaactaatgtcagaagtttgtttgcacacttctgtaattaactacaaacatatattcaagagtattctcttatcatttcattctatgttataaaaaaccttcagtctcataagtcacattatagagcattacgttttcctcccatggtgaaaaggattagttcttagcaataacttaagaacacatcttttgtcagtgtctctgagggataaatatttcctggttgagtgtttatgcacagaggaaaaattactgaagtctgtgcccaaatatagcttctgtaaacttgaaaaatataaaagagaatttagtgaggaaaggagacagagagtagctccttttggactataatacaaacacattttctaagaactaggccttggggatcataatcaactagcctgagccacacacaatggataggtatttctgactggcactttttagctgtaaggcatgacatgaaattgcaatgagagagctacaaaaaggccatagagacaagtatccagcttaacctttctccctatgcagttgtcttctttaccacagtgatgctggctggtcaatttagctcctgcttgaatacttactatgaaaagaaactcttgctttatgttacatgtgcatcattcatttagacaaatttttaatgcatttacttattgaagtctaaaggtacacaaatgaagaagatgtggttcctgatcttgcagtttccagtttataacaaggaacagaaatatacatgatttaatataacgtatggtcatagtagagctgaaaatctgaagctttggctaaaatgaggaaggagtacctaaatgggcctggtatttgctaaatgtatagagggaacaacatttaattgaggaaataagtaggagatttccactgatagaatggtagaagtagggctgtgatgggtgtgggggacatggaggggaaaggcaaatggcacagaggcttgaaaactcctggcatgtttgggtgagaggtgagagattctatgtggctacatcacagcaatataaatgtcatgttggaaagtgagtctggagaagaaaattggggcaaacaatccaaagtctcaattagtacaaagccatggggacccagactctgtctctgtaatactgaggacagatgcagcatagagtagatattacaacaagatactatggcgctaccctgcctaagtttcaatgtgctctcaaatagttggtgactttggacaagttgtttatccccaccctgactaatacatgctctatgcctcagtttacttatctgcaaaatgaggatattaatatttagctcattggattgttttgaggagtattggacaaaattcttttaaagtatgtaaaattatatccttttaataacaacattgattaaatagattccaagtatgtattggagcagagagagtccagatgatgatccctgaaatccagcagtggccaaaaataaaagaggagagaagaatgcatgatcattgcaactcgagacagatttagctattagaaagttctttcttatattacacctaaatttgctctccttcatgcaaagaattcaatttctactggctggccctatttctaccttccacctaatagacttacatataataaaaattcagatgttatatttttcccagattatatcttttttaattttgtaaaaataaataaataaataaaagagtttgacatttcactcacgagtcatccttagaaagagtaaaagatcagaggctgggcacggtggctcacgcctgtaatcccagaactttgggaggccaaggcgggcggatcacctgaggtcaggagttcgagaccatcctggctaacacagtgaaaccccgtctctactaaaaatacaaaaaattagctgggtgtcgtggcatacgcctgtagtcccagctacttgggaggctgaggcaggagaatcacttgaacccgggaggcagaagttacagtgagccatgcgccactgcactccggcctgggtgacagagcgagactccatctcagaaaaaatataaatatatagaaataaagatcagaaaggcccattgtaagtactaatggttccagtgagatacagcaggcagcacagtaagcagcgcctctattgttagggtagaaagcagtcacaggcagaaattcaataaaaataagaagaaaaatattttagagtccccaaatcctacctccttcaaaagttactcatccaaaatcctttttaaactgtaacattctgtacagacaccagtttttcaaatataattgctaagatgtgaggcataaacataaatctaaatttcattgagtaccacgtaatgttcagctattatcatacttggaaacacatggataaaatgaatgttgaaatagtcatgactctggtatgtctaccaatgcgcagttgatttatactgtcatttattgtgaatgtgccataaatgacaagctacttatgacattgaattgaaccattctttttggaagtctctatgccagacattgttctaaaggctaagagtttaaaagattcaaaaacacaatagttccctagtttgccttccttcctacatgtccttgcctgctctcctaactcctaccccagtctttgcccaactttggcattttcccaagaaagattgcattccaagaatcacagtggtatttggaaatattttgagatttcgaaataaataattcttccttttaaaacaaataatttttctgagaatcaattaatcgtctaactttaaataaagtaaaaatggataggaattaaactccaatatattgaggcaaacagtctttattttgaaaatcctttttaaaggtttccacaaataactctttaaaggaaagggctaatatttccttcaggaaaatttacaacaatctgttaaccaaactagatcttcaagccccttaccaattcctctccccaattgagtgttttccaaaggtccaatttggaattccttttctttttctttttttcctttctgtaaagggtgagcatacttaggaaattagttaaaattactccattgaatgctctgttgttccttagtattgagggaaggttcaacatatgttaattttgggaatttttttagatactgcaagactatcacatgtagcttagtctcacagcaaggatatccacacaacgtgctattagcaagtaggatgccagccgccacagaccagtattagcctaataggatgaaagatattttgatataaacaaacatgcgagaccacacagtcagtaaacattttatagacaaaaggagaactctaatgacattcatttggcctttggagaggatgcattcggggcatttttcatgttataaaggataattgaatccaaacagtgttcatatgggaacactaaagctctaacagtacataacagagccaagtcagactttttaatatttatatgttcttttagggaaattgttctggttcctgcagatgattaataatacctgctgcatttgcataattcacggtgttaaataattaacaggattataattatattcataattctttatcaattgaagttaataactttggtctgctctagcgcgctatgttattgaactaagatctgtacttcaaaataatgattctagttaatattagcaacacatattacatatctagccctttctttatattccccagtcagctttgacaaattgagtatatggtttaagtcccttaatattcagtgagaagaaatgcattttaaaatctggaaatctgtctgtatttaaacataaatataaataaataaatgaacaaataaataaataaagagctttatatctatactgaggtgtataccatatctatctttatatatatagatatgtgatatttatttttactgcaaagagatagtaaactttttattttagaataggttacaagtaggaaacaaatatacttaaaaaataataaaggtgtacaagatgcaaccatttgcataaaatctaccagtaggtgggtcactcattggccttttgtgaagagatatatttacttcaggacctgaccaattagcctagatgaatattatatttttattacaagtatgtggtgtgattatattattattacaaaattataacaaaaaaagtaatgtagaagtactatatataggaggccttcagcttgtatcccttactcatacttccatcaaaaatgaagcatagaagtatttggagtattgatttattttagtcattcattagctatcatggtcttatccatgtctgaaaatcaaatgcaagatgtactttagtgaagaatgcaataaaaattaatatctgtgcttgtggggtaacaaagttaaaaccaaggcacctttttctactgaaaaggtgtatgaattaaaataacaacaacaaaaaactactatataattcagtctccattcaaataacttataaaatagcttggatgttttcttgaaacatcaatattattaagaagatattccaatacagaaataatttattctgtataaaccgtacttaaaaatgcatggagcctattgtagctgcctaatggttttgtaatatttttgttgaagtggcttaagtacaaaggtttaattgcttattataaaagactaaatattttatatcaatgaattaaatttaaaaaatatctgccattaccacaatagtccagtgggttgcagataatctgagtcaatttaactctcttatcaagagattctgcccagaaaattagcaaccattattatgttctgaaagaacacaaaaggtctataataacattgaaccaattattaaatgtatatttttcttctaagagaagttcgcttctttaaaatttggattacaatatagagaatatcacctaaattattcattttaattaagtcatttcctgattttgtcttagcagatacagtcaattaagaaattatccatattagccttgcatcataagtaagccctaattctgcaaaaattgagtattgtttcatttcctgattctaaatttgcaagccacagaaagtcagatcaaaaataaagattacgagtctaggcttatgatgttaatttagtggatattttaatttaaagatctcaagatgtccctaaaacattctaaaatttttatagctgtaatgttgacaatatctggcatgggatttgaagagattaatggcaagaagagggatttttatgttgtttcatgcaccagagaaaatgaagctaaagggattttgaaaacaagaatgaatcgagagttttgctgttctaagttatgtaaagatatcatggactttatatcccagttcaatgtagaacttcataattttataaatatacatatatacataaatatctaacacatatacatatacttaatataattcatgcatatatatgcatatatacatacatacttcatactgtatatacctactttaatatatagatacacatatgtatgcatacacacatacacacacttaactataatatatatatacatatgcttaatataattcatgcatatatatgcatatatacataccttcatattgcatatacatactttaatatatagatacacacatatgtatgcatacacacagacagacacttatctataatatatatacacctgtctgttcttaccacagatatattcctaggagggtggtagttaaggtactaaagtagggtcatgtaaaatgagattttagtaaattcagaaagactttggaaataatctaccttatttacataaaaaataatatggtgaaatagcaaacaaaatgatcgtatgtctgttaaaccaaatattgtattgacattacttacgaatactaaagtctgaatttttttcttgttttttgctgctgtgttcataatgttatgatacacgatgatctagtacaaggaatttcttgaaagcatatttcaagaaaatagaggtaaagggctctattttatcaatgccattagttactggccacctgctcttatgcgtagggttctgtttaggatatagacatataaataacaaaaatataaatacataaaaaagccatttgccaagtgccaaatggtgcagggagttggaagtcggagattttatcattaccatggctagcataataaaaacagaaagaaaataataaggagatacaaaacagatgggcaagaaaaagaattttcaagaaatgtgaagggaaatagtaaagagaaagactatttaagatgaaaaatgttaatatgagaaaatcaaatgatgaaaaatagcaagtttttttttttagcaagagaatttattcttcatagaacctgtatgacatttatttaagaaacacagaatggtgtcatttcaatttcatgacattccttgtactggtggtacaattttttatacacaggaataaaaaaggaataaaaaagtaaaaggataaataacatagttgagtcctgagaaaacacgggtttgaactgcatgggtccacttacatgccatttttttcaaccagactcagatcaaaaatacagtattcgcagaatgtgaaacctacgtatatagagggccaattttgcctgtgtgcgggttctgcagagttggctgtgaaatgtgagtatgttcagattttggtatacatgagagtactggaaccaataccacgtgcatgctgagggacaactgtatatagttgggagctgtacaaatatataactttactcatgtcttagaacccaaatacagctaaataatacacctgcataacttgaatgtcgttctgggtttttagtactgttggaaagtgtagaccctacactatgcaagtgggttggatgaaggatgacaatgtgcagtcaagtcttgttattcactgtgtttctataaagtcactgtgaacactgaattagtgaatactgaagcattcctcccaggagaaatacaatgatagatttctgggagcctctgctcataacatttttgtgaaccagcaatgtataatcccattttgcctgtttttctgtttaaaaacatcttattgaatatatattattgatccattaacattcaatacacagccaacagcactgtaactcaagcctgaaggaaacttacctaaggaacctattttctttctaaggtacttcacagccttcttaagcttaggaacactagacagaaattcaccatcatgcttggggccatttaaagcagcaaaatcaccaagaaaaagcataaaaatatgaaaaacatagcattaaatacaccgctgaaaggacacttgtttaccgtatgagacctgaagcaagaatgcagagtgttccttttttgatctcagctgggaacatgtgtggtgggtgacttaaatttttcaccactctatgcatacacacaaatggctgtgaaaatgctatgagcattgattttagggatacaaattaaatttagcaagttttgagaactcccaaacacagaatgtgtgaataatgagaaccatctgtacaaagtttcaatcaatatactgcttgattaggccctttttataaagcactatactgtttttagttgcaaatggttaaatcctttcatcccatttggttatggtgtttgtacagaaaactaaattacagacatgtgtattgttgactttctctaattgcccttttgaatgatctgagcagagatcaactgctggaccaaattgtacgtcgagattataatatccaggttttgtcaggcactatggttaagaagtattgtcagttaagatgtactgcaattttaagcaaaagatttttttacatgctcaatctactaagtaaccaggagaagacaaatgtacaagatatttccaagagcattcttgttaccaactgaagaactgtattaataattcagtcctatacagtgctacttagaacttcagtgtcttcttgttaagcgaagtggatgtaaaaaaaaaaaaaatgcaaaggaatgtcataaatgcagtgaatacaaagctgaatttctaaaaagtggagcttgcaaagggactgtaggtgcaatttagtttgaaataggtatgaaatcaaaattttaataacaagtgtcactttgtataccaaaacctgttcatcaatataatcaaacacctagatatccatctgccttgatgatgtttaccatgaatttcataatcccaagtcaaacccagtgtattctactcacatatttgtgagctgtcattaaaggaagctagaacagaatgtagtatgtcatatatatgtgtgtgtgtgtgtgtgtaatgtgagaatgtgcatttatgcaactgagtgtgtgtttgtgtgccttgaggttaagatgtacaagaagtaagcatttggaaagtttgctttgacattacacacgcacacacacacacacacaacccccatttatgtatatatctacacaaacatagacataataattatattaaactctactagtttcctattgctcatataataaattaccatgaacttagtgatttaaatgtacatatattttttatcttttatttttttgagacagagtctcagtcactctgtcgcccaggctggagtgtggtggcacgatctcggctcactgcaacctctatctcccaggcccaagcaattctgatgcctcagcttcccaagtcgctgggactacaggcgtgcatcaccaccccaagcaaatttttgtatttttagtagagatgggcttttaccattttggccaggcaggtctcaaactcctgacctcatgtgatccgtccaccttggcctcgcaaagtgttgggattacatgcgtgatccactgtgcccagcctgttttttttttgtttttttttttttttttatctttcttagagttctggactaaaaccaaggtgtcaatggggcgctgttcattctggagactctaggggagaatccatttcctagcttctagaggctgcctacattccttgattcatggcccctttcctccattttcaaagcaagcagtatagcatcttccagtctacatcacattactctgacacactgcttttcattccaacatctcctttgactccttgaaggatttttttcttccttttttttgatacggagtttcactcttgttgcccaggctggagtgcaatggcgtgatcttggctcactacaacttccgcctcctgggttcaagcaattctcctgcctcagcctcccaagtagctgggattacaggcatgcaccaccatgcctggctaattttgtattttgtagtagagaaggggtttcaccatgttggccaagctggtcttgaactcctgacctcaggtgatccacccgcctcagcctcccaaagtgctgggattacaggcatgagccaccgcacctagccaccttgaaggatctttgtgtgtttgtgcttatttttaattggttccatccacataatccaggataatcttaccatctcaaagtccctaatttaatcaaatctgcaaagtaaactttgcctttttatggtaaaatattaacttaacgggactgggttgttcaaactctgtacattccaaagaaatatctggctcttgactggcttctgggcaataccagatagtttattttaataatgtatggtgcagcttttaggttacactgtatcagtttgaactctggagaggctggagatgactaaagtcagccatgtgagtgttccatgcctactacaaactccaatacaattctagacaccaagacttaggcaacttttcgttggcaatacgatgtgtgtgttgtcacacatcactgttgggataattaaatgctgtccagatgacttcatgaggagaggaaaactggaaggtggcacctggtctttcctgaacccggttgtatgcaacttttttctttgttcacttcagtctttatctttttgttgtaataaactgtaatcatgagtgtaactgcttttaagaattatatgagtcctcctaaggaataattgaacctgagagtagacttgaggactcctaaatttcgccatataaggcaacatattcatagcttcctaagattagaacatgtatgtctttgggggatcattactatgcctacaacagtacataaaatacatgactcttgtgtagaaacttcttcaatttatttgaccagaggactagttttttttttaatattgtcaaaaaagcttggaaacatatgttcctttattgagtcaagattcagttttcttaagagatttttatcaaatgttttgcaatatacctcttgaaaactaccctttcctatatgtagaataaaaattaaaagcacaattaaaagcaaaaacctgtcatattactttccatgtttgttatctagtaaatgactctgtaatcaactatttcctagcaataaacactgaaaaacatactcaactttcatctaagagtacaagaagtaatcaagggaatgggaaaactcaattagctaccagagactgtaaaacatctgttctgaaaaccaaactccaacaattcaatatcaatatctttaaagggataaagattattaatgtaaaattgaactaggaaagatgaaaaacccctgcactaattctcaattatattgggtttaaaggaaaggcaggaataaatcatatatacccatagatggaaataatccaggtatacatacacacacacatacatatatgaaaaatctataagcgttaggttttatattagtatccatgatctattttgagttaatgtttgaataaagtatgaggtgttcaggtcaagtttatttctctgcctatgtgtatccaaataccctagcatcatttgttgaaaatgatagtttccttcattgaattgcttttacacctttgcaaagaatcagtttggcataataatttccttctatttctgggttctgtattttattacattgctccatgtttctgtctcaccaccaatatcacattgtcttcattactgtagctatatactaaggtcttcatgttgagtagagcaattcctcccacattaatcgttttcagtcatgaaatctatagatcgatttgggaagaattgacatctttactatgctgagtcttccaatccatgaatgcaatatatccctgaaattatttaggtcttgatttcttttatcagcattttgtaattttcaggatatatatctcatatatatattgttaatatcttactatttcatttttggggaataatagtaaatgctatttttttcttttttctttttgtgtttttaattctaaatttttaaaaagaaattttaagaatatctaaaatttcaaacgccaagttccttctagcaataatgggaaaaattaacgtttattttgaaggttttttttcttatctgacaagtgatgttgaatctcacttacacaattaaaaagaaacaatacacaataactattacaacaaaatgaacagactttggtactggtttgaagagattaagagcttaaatggtcttaaagagattatattgctcatttgccagaatccatgctttcaaagaaggctgaccacaggcagcctttggaaattaattattaagtgtatattattatatataaaaccttttcatgctgcaaacactacaatatatttctgcaatatcaactaagaattttattctttttctatgcttacattttagaaaataacagtgttttaagtcaacaacatacatggatggtaatatttatgctaaatatggcataacaaccaaataactccttttatttagattcccatatactataaaaacttacaatgcatctacaatttaataaagtatgtgttatcaaacaatactataaaatgaataattgtagtagaaaccaaggttttacccccctctttttgagaattatgctttacatcagtcctccttccattagtctgttagttaaaaagcatattgtcactgcaaaattaattgtaatgtttcctatgcagacatagtgcttaatagagcccactgtctcaatagaaaaggaatctgtctagtttcagccaaatttatttagagtcagataaatttgattaaacataaaacaagtatccatattgaacacctcagttacctaatcctttacagtctagtccattattaacagtattaagatcataagggattaataaagtttctacagaagggaacattttcccttgtctgatttcagtaaaggagcatatagctttgataaaatgaaatcatcatcatcattttctaaaatattctttatgttttatgtttcttgggcttactgtgctgattaagtggagtgataacatattgcactggtaccttatcactccacttaatcaatacagtaatagagctattagtttgaatcctaaaaacttatcattttttggtcaaaatggaccaatatcagcaaattcatatgattcaatctatgtatctatcttaggtatatatggagtggcgtatgaataaacagatatatatatgatttgatgagttaagaataattgggtccagagaaataaagttctctaggcaccactgttctactgaaacaattaatttgttttgatctttatatacatgttcgattagatgatttaaaattttaaagtattaaaagtttaaaaactagttttaaaagtttttttaaaatgatgtttacacatttaattactcagtgtattttttttttttttcgagacagagtcttgctctgtcacccagggtgaagtgcagtgacaccatttccgctcactgcaacccccacctcccaggttcgagtgattctccagcctcagccaccctaaagtgtgccaccatgcccagcaaaattttttttttgtttgtttgtatttcttagtagagacagggtttcaccatgttggccaagctggtctcgaactcctgacctcaaatgatccacctgcctcagcctcccaaagtgctggggttacaggcatgagtcaccttgcctggcctacttcctcagtcttactgagtattttcccctgagaattagataattggccttaccacattccaaaatccagtgattctcttcttaacatgctcatgttatatcccacacaacagtactaatacattattctaattttgcttgcaatgttgctatagtatgaatatttgtgttcctccaaaatttaaatgttgaaagctaatccccaagaggttggtattagggggtgaggtctttaggttgtgattaggttatgagtacagagccttcttgtttgggattagtacccttataaaagagaccctagagagccagctcgcctcttcatcatataaggacacagcaacaaggtaccatctagtagctaggaaacggtctgtcatcaggcacagagtgtgccttcatcttgatcttggacttcccagcctccagaactttgagcaatgaatctctgttgtttctacgccacccagtttattatttttttagtttacgccacccagtttattatttatttttttttatagaagcccaaatggatgaagaatgatagttatttcatagtgaagaatataaaaataatcagcatcactacatccataatcagagaagggaggggtgggataatgaacagagtcataagtataatgtatttagaaatctgggatgaaatcccataaactgaattgagttgagtgccctcctcccccatgatgagtgtgtatgaaaatgcactagagagacagaaatgaaaaatcagggccatcctcaccatgctctgaactcctatgagattcacttgtcatctttcttttaaagatcttatcgtgtattatctgatattacagttacccattatgaggaattatcataagcataacctttatcatcattatcacctttactatcatcgtcatagacagatgtaaatctagcagaatgcaaatataagaaaatgggacctgactcacgtaagaagactttgaaagtttttcttctatcaaaatctgacaagttggcttaaaagggaagatgtgttcataacagtttctttcattttttccatttccatggctaattacattgtaatactccattaaggtaaggatatagcattgtttgtggtgaaatagactctccatgagcaataatttagattgaaaaaggtaaaatatatatatttccacagtttactttatgcaaatggagtgagttgtaatttttggtgagtgggtgagaggtcagttagatgactgtatggaatttaaaaatatccaattacatatatggcagcatcagaagtctctttagcaactctcacaatattgtatagagataaaagcagtcagacagggcaataatcagagccatattactcatttataaaatctcaatgaaaattttctctgaattaagcgttaacaaagaaggatgaggctcaattgtgatggtacgacagacaccaaatgccaatggtacaatacgtttagtacaattgccatacttctatgtgatgttttgtttttatcatgatgttggagcaatagccacagggacagaagtaagcgggttagagggtaaaagttgaatgaatatgtacaggtataccttggagatactgcaggttcagttccagatcaccaaaataaagtgagtcacatgaattattcggtttcccagtgtatataaaagttatatttacattattttgtagcctaagtgtgcaaagcattatgttaaaaaatgtacataccttaacaaaaacataatttattgctaaaaaagctagcaatcatctgagcctttagtgagttgtaatctttttgctagtggaggctcttgcctcaatgtggatggctgctgattgatcagggtggggttgctgaaggtgggagtgactgtgacaactttgtaaaataagacaacaatgaattttgctgcatcaattgactctttctttcacaaaacatttctttgtagcatgtgctgctgtttgatagcactttactcacagtagaacttctttcaaaattggagtcagtcttctcaaattctgccactactttatcagctaagtatgtgtaatattctaaatcctttgttgtcatctcaacaatgttctcagcatcttcaccagaagtaaattttatctcaagaaagcactttctttgctcatccatcagatgcaattcctcatccattcacgctttattatgagattttaggaattcagcaacatcttcaggctccacttctcattttaattctcttgctattgtcaccatatctccagtgacttcttccagtgacaacttgagctccttaaagtcatccatgagggttgaaatcagcttcttctaaactcctgttaaatgtgatattttgacctcctccgatgaatcatgaatgttattaatggcatctagaatggtgaattccttacagaaggctttcaatttcctttgctcatatccatcagaagatttattatttacagcagctataaccttactaaatgtatttcttaaataatgagacataaatgttgaacttactctttgacccatgggctacagaatggatgttatattagcaggtatgaaaacaacatgagtctccttgtacatctccaaatgagctcttggatgaccagctacattattaatgagcagtaatatttttgaaaaaaaaaatatatttttctgagcacaaggtctcaaccccgggcttaaaatattcagtaaatcatgctgtaaacagatgtgctctcatccaggctttattgttacttttatagagcaaaggctaagtctatttagcataattcttaagggccctaggattttcagaatggtaaatgagcattgcttcaacttaaagtcaccagctgcattagactctagcaaaagaatcaccctgtcctttgaagctttgaagccaggcattgacttctcctttctagctatgaaaatcctagatggcatcttcttcaaatagaaggctatttcatctacataaaaaatctgtcatttagtataaccacttttatcaatgatcttagctagaacttctggataacttgctgcagcttctccaactgcacttgctgcctcaccttgcacttttatgtttggaggtggcttctttccttaaacttcataaaccaacttctgctagcttccaacttttcttctgcagcttccttacctctcagccttcgtagaattgaagagagttgggatcttcctctggattagctcttggttaagggaatattgtggctggtttgatctgtctagaccatttaaattttatccatatcagcagtaagactgctttgctttcttttcattcatgtgtgcatgggggtaacacttttaatttccttcaataatttttcctttgcattcacaccttgactaactgtctggtgcaagacgcctagatttcagcctaactcagcttttgacatgccctcctcactaaacataatcatctctagcttttcatttaagatgagacatgtgagactcttcctttcacttgaacacttagagaccactgtggggttgttaactggcttcatttcaatattggtttgtctcagaatagaaaggtccaaggagagggagacagatgtgggggggtgggggtggccggttggtagagcactcagaacacacacaacattgattaagtttgttatttcatatgggcatgactcatgttgcccccaaaaatgacaatagtaacttcaaagatcattgatcatagatcatagatctccatatattctttcagtgtggcttttgtactctaaccagtgtcagcttgttgagggcagaaatcatttctgattaatctttctatgctttcagtgttactaagtgaatgatatttgaactgcaaaaatgtgatgaaatgtgaagatatgacagtgagtcaagaaagaagatacctctgggctttattcatgaaacagcagagatataaatagctttaacatataaattggttgaaagtaagttaaagcaaaatccctatgctaaagagttataatactgtctattgtgatgtaaatatgatagttgaattcataagaaatttttcaatggcaaaatgaggcttggtgatgagattatcatctctaagaaaattcagtcttaagtattactttatgtcgtttttattctccctgaaagtggcctcaaacattctatcttcatcaacattatccttaccacagtgctacttacacattttcccaatttatcaccagctgtcatgcaaaacccagaacaaagccacttagccaaagcacatgtttgactatgaattagacttcttctttttaaaacaaaggtattatttaaacctattgatgctggcttccatcttaagcccataactggcaaccaacaggttagaaaataaaatttcctaattaattgattaggaaattaaccaatttttgttacatctaatactggttggatgtattgttacatccaatactgtttgtgaaaacttgtgctgttggacttgttgtgcttgttgtactcagtcttgcttaatttgtgaaagcatcacacatttaaagtagcccattagctgctttctagctgaggatgagtaggtaaagacaattatttctacatttgtagttggaagtagtcgtagatattatctaattcagtggctttcttcaagatctcagttttctacagctgtgtctatggggttatagggtgaaagttggaataaatggcagttgaatcaaatcgtcctcttgttttcattcaagatgtctacaccttcaattcttcttttctttgctgggctttcatatgagatttttaaaaaaatgtgtcctgtgtatttttaaaatgaaacttgatctattacagtatattctacagttggcaaatatatgaaatattttctatccttcccactgcattcatgccgagcacatacggcatcaaataatggtattttatcccacgagttccaagtagatacagtctcagtctgttatagtactcctggaaactactatcaagcaattgcacatggtgtgatcaacatttgttatcttttctatcactttctatcttctttattctttaatgatttgtaatcgaatgcttccattttttcagaagagaataaaaggcccagaatggtaatgactgttaccaagtcacgatgtagcaaaattggtgtgtcacttctgacagtttctctaactcccaaaccaatgcatattttgataattgccctcattatttcctcaaatatacttccctgtcagaaaaaaatgattatatataaaattaaatgaggaaaactattaataataaaatatcatgttgtcttgggttgccttttaccagaagtagaccctgagcaaattatttgagtgccagcaacttatttcggaggtgatcccaggaagcacagcaaagaagtgagtgagacggagaaaagaacaccagtacagtgtgagtttcatgagcatgtcatcagtgataaaatgaggttcagtaccacttgagaccactaggagaatgatttgtctcacctgagaagcaagaaaggtagggtagttcccacaaactcccatgtgtaatgtgttaagaacaataatcattataattaaataatggattattaactatcacaacattgtagttctattagtctgagccttaatgcatacagatttttgcaaacttcatggaagtttccattttatttgaaattagtttttgattaaaaataatggaacgctccttcaatcaattaaaaatatcagcagatccatctgcttggaaaatgattcttcctgatgctggcttccatcctactggttgacatcattacgttgggttaagcagtgacatgggtaattgttcttaaaatgtgatcaattctcttattctcccacacacttttgacctgcatttattctctatctttgttatattaaagattgtcaatgttttcccttaatttgacagcacaaatgaatatcaacatggcactattgcctcaaaatggaaaaggcaaaaaagcaatcatgaatcacatgtttctttaatatacagttacagattttgagttcatttccacttctgattgtggttatatcttccaccttccctttcctttcatgccgttttatattaaaggtcaatatgttcatttattaattatgcaacaagtgtcatgtttacaatgtttgtaaatgtagtcacagtatttgattttcttaatataataaaatttatcctctgctttggctaatataagcccacaaatgatcatttcattttctaataaattaaaagtataatgtatacaattggattctgtcaggcttgatgtgtcttttaaacacagcacattaaattccactatgtataaaaaggactgtatataatgtcaatagagaataaacagaattgctacaaaaagcatcgacataaatgattaaatatacatagctcttggcatgtggcttcctgttacacagaattgtgctttttaataatggataatttcaaaaccaatttgctggatacttaatgcatctttgagattttccttccacagagaagatttaggagattataaagtaattaatttgttcacttctttattaattttctaatatcacaaagctatgcattagaaggaagtaggtattaacatctcatatcatttgatacatccactgaattcctacgctctttgcagcctcaaggcacctgtgtgctggcagactttgcagagtactactgaagttgaggctgtaaaccaatcacgcatttgctctgctttcatattgctggcattatacatctgctattcgccaaccccaaatccttcagtatgtagttctcattttctgatgaaaattcagtggaaaaaatggaagtagatatttgcttttaatttcaggtatactttacaataaccatgctgcacagtacaattgggtgattggtgaactccatcattttctattagtgatgaaacaagacaaatgaagaaccacatttttgctttgtgttactttaccaatatgcctgaatccatgtaccttataaacgaaactgtcaatttactcttctattattttaggtgatgattccattaaattaagacctctggggaggtcatgtgtaagtcacaaaggaaatagagcctttaaaataccatgtagggtaactatcataccatcataactaaatatcccgacttttacggtgtgaaatagacaaaaatggtaacttgggtcaacgcatttccctaaactgaatgaggaggaatcttgacaatagtactgctcgtgtactatggttagtaatattagagggaagaaggatgcaatggaaatgatgtcaccttaggactcaaacaaatgtcttactggctgtgtaactcattactactttaagttaaacttgagtagctccctccagaagagctaagcaaagggtaaaaaaaaaaaaagaatagagaattcatggccctcaggcactaatagtttatgaataaatcaataacctgaaaagtacatcacagcaaaataagtggtgaaacaagtattaggaagattctatgcacaggggtgcatgattcagccaaaagtaaagaagaggcactagctacactattttggaggattataaagcatgtaccaagtaaatatatgtgaataagaattgtttatgactgtgggatggagtcaacatttccaaaggcacatgaaaaggaagtgtgttacagtcagagaactgtttgtatggctagggtgaggcattcacatggtggatataagattagactgagcacatggcagggaaattgttgtaaagtaccttctcttcatgcaagttatttgaattataatctataaataatataaagccacctgtggactttaagcagtggaataacttattaagttttgtctttgagagagataagcctagcagccttgtgaagggtaaactggagagaagcaagaaggaaggtacattaggaagctatcagtgtattcgaagtcagatatggggatctaaactaaggtggtgactgtcaggagatatggaggggggatggcagagctaaaagaaatttaggatacaaataggagaaattagttacatggctctctataaagaggaaataagacttcctaccttgcttacctcatatggttcctatgtgaataaattaaacttgaaagtattttgttaattttaaagctttatacatttaaggaattaagattatcaagtacttatgaattaaatgtacttgttttattgacattcctatttgttcacatacagtgaaacaactataaacatttgcttcacttactccttaagaggaaagtagcatgctaggtaactcatctggatttaaatttctaagtggaagtactattgagtatctactctgcatgaagctagggaagtgtggcaaggggactctagccaaggactagaagatagagagactgagagcaagttgtttctcaggcatctgtggaatgcttctccaatgaacaagaaagagaaagaaatatttggaactaaaatatgcatgagaagtaatcaaccttggaataggttgctaaaaagaattaaaagattcttataataagttcagtctctaaatgcaagaaaagtttagtaataatctggtctctggatattaactcacctaatccgtatttaggttgcacatgaataagagttccgtatttagaaaattgtatttattcaatacaatgaataaaatcaaggccaacgaagtgacttctctaattaccgttttggaaaaaaaagatacagaaaatgaattatttaatgatattggaaaaagaggttatccctaagacctatgtatggcagaagaactaaaggcaggtagtgacccaaatctgtatcactaactcaatttccttccaagcaggtacagaagtagatcatggaaggagtgaaatgcatagaatcttataaagatctggttctgattagagctgtttcacaagtagcttaatctcacttaggctcagcttctagatctataaactaggcataataaaacattttggcgggggttgttccaaagattagctaaaataacgcatgaactgcacctagcatgttaaaaataaatagtaaatattaatgtactagtaattatgttttgtaaactaaattttatctcactaaaagaaagtattgtaaaatttatgttgttcttcatccactatagaaaatgaaaactttttgaattagaaccaaatttggaatgggaacatccaagtaataagaataaatgtgaaaagaaactgaatataataataaagttatgaaagaggaaaaataaaatctgatgccgaaaagaacatataggttttttttgttttgttttgttttcctttgttttttgagacagaatctcactctgtcacccaggttggagtgcactggcacgatcttgactcattgcaacctcagcctcctgggttcaagcgattcttctgcctcagcctcccgagtagctgggactacaggcacgtgagcccacctaatttttgtgtttttagtagagatggggtttcaccatattggccaggctggtctcgaactcctgacctcatgatacacccacctcgacctcccaaaatgctgggattacaggcatgagccaccacgcccggcccatacaggtttaaatattgcatggccatgctatacaacagtttgttagctgaagatatttttgttcacaaaatcaatgagattaatcacgcatcactctatacttgctattaaaattactatgtcacgcattttgtggccttccaaaagagacaaggagtttgagtcacagtattagacaagactaaagaccctacatggtttactagaaaaaaaccctttacttcagtgtcaggagacttttattacgtatctggccttactactaactggaagaaacttaaaagaaatgacaatttctctataagtcacactttcctcatctttcaaactaagatatgggactaaatattctttaatggtctccgggttttgaaattctaagttcctataaaagatatctgtctagatgtttgcaacacatacaataaatgtagggaccatataaaaatgtaaagatctcatacctataaaaaccaaaattgtaaatcaatagaaaaatgagcatgagattagaaaagtgcacttttatatatttgtgttatagttcagtaaaacattttaaaaatcaagttgatagaattactttctttaatctacaaagggaaattactaatgaaagttgggaggaaatgttatccttactatagataacatccacatgagcaataaacacaaaaaatggttctcaaattaattagtcactagaaaaaaatggaaatgagaaacacaatgagatactatagtataacagccagaaaggctgaaattaaagactaataatgctaagcattgacatgtccagaacttctataaagtaatgatggttctttgtttacctaccttgaaaaactacgtggcattttcaactaaagatgagtatttcactattctatgacctaataattctacttcttggcacataacagaactacatgcatatgtgcagtaaatttgcaagaatattcaaagtggaattatttttaagagttcacaaatggaatcaatttaaatgttcatccagagtagatggaataagtaaattataggacatttatatgatggcatactacacaacactgaaaattatgggaccacaactacaagaaacaaattagatagatctcacaaacagaatgttgagatttaggagccagaaacaaaagagtacagctgtatggcttcaagtacatacatttcaggaactgtctgtcctaatcaatggtgtgttagatgtcagtattccacttacctctgggagagtattgactaggaagtggtaagacaaagtttttggatgctggtaatattcttttcttgccttgagtaattactggggtgtgcccaatctgtgaaaattcatgaagctggacacctattgatttgtgaacttttatatattcgtgttatagttcagtaaaatgttttaaaaatcaaggaggacagaaatactttccttaatctataaagggaaattactaatgaatgttgggaggaatttttctttgcctttagcctatatatctaagttacttcagcgagtcagagatataaatagatatatagataaatatatacatatatgtgtatatatgcatatctatatatgtcagaagaagggagagagaaagaggagagagagagacttttttcgataattaaattctttagaaaatgtactgcttgagagagaatgactttctggatgattcgattcttcagaaaatatcttgtttacctgtctctttttaatttcctaggaggagttgggtgtgaggctggagatcaattaaattggaagatgttgaaattggataaaaccttacggattatctaacacaatttcttattgttacaggtttatttggcaatagatctattctatctgagatgttatcctttcagccctcctttgtaacctctgaggtctgattctgtgattaatttaactttatacatgagtgaaacattttcaggtagcttctaattaaagagtgttagacattgagataaaatatgacaaggtctctaaagatagcataggaaaaagtttccagggatagacgtacataaactaccaatgggaggtaactgttttcaaatcctcctgaaagtttgcatggtcatgctcatgctagctttaatcatatttaatatcattgtatgcaactggcttttagaccagcctagacattttccttctaggtttgattccagtgaagatgagcaacaggtggaaggcatgctcctttttatttcaagtgacacttcaaatatgtcgctttaccctttactttgaattactatttttcactggatttgctttctttctgttcagttatcattttgctctttgatggacttgccagtttttccacatcactcacactaggaactccggaaacctctagctcagtcctaagtcagctttactgtctgggttcacagttgctgttgctctctgcttagctattcactgtaaatatttttctcttctcatccacataaaccacgttcgtctctaaattcctcagggactgtatcttagtcatcttgctctagcacagagcctggcagttagaatttatcaataaatatttgttggatgaatgaaaagcagcagaaacaacctttcatttcagttggtgggctctaatcctgtctggatgacctaatggagaaatagactctgtttcctgccactgtggccaccaaaaccagcccatgaatgggtcagcagccaaagggagaggaacctgagattcctactcactaatgtgtccatcacatgcaggcttttacttaatctcctttttacacttgtcatagaacataaatgagtcccacatctcccctaaaacccatacaatttcaggttagcattagtgtcactttcaataatccagcttattgttgctggaccgaacaattctacttatagcatgtataaaagaaatctgtactagtaaaaacagactatgatggtccttatcacattttatcctgggagtgttataatcagttgtaacaatgtcatgaccagagctgaatgatgctgataagtttattttcccttagctctttgtattcataaccctgtcttcaaattgcaacataatgtcaatatttcttctggaaatttgataagcaccatccatttaccttcaggtgtacattgacagcaattaatctctgcgtaccacctacgtttccagttgtcatcctgtacctcctctataaacgtttgctcaaaagaacatctcagttttacttttgtctagacaatatttttacccatttgcttatttactgcagtgcactttaggctgtaaccccaaagctcaagaaaataagttttttggaagccagtcatgttaggcatataatttatatgtttataatttaagtcatcttttcaaaagtagtatatatattgaatatttaaagtattcttgttttattcagatgtcacattttatattgcaattagtatctataggtcaaaatgtatggagttataaaaaaggttttctttaaaaaatttgctttccaacactatcaaaggagacactgaaacattacagctaacttgagttttttcatttaatttaaagatagtgtgaacaggtactgaagacactgtcttacattttactaatatctatatagagtggattaaatttgtgaaaacatatatctgcacagagtctataaatttctcaaggtcagaaaataaaccataaaaagatttaattcctctaaagctttaagcatgctaacatttgttaacttgatcttataaaatgacatttgagatgtgtttatcttccaacctaaaatattaatttttattgatcaggttataagtttttgcttacttgcaataactttattattttttctgttgaccctaacatataacaaatgaagacatgtgcagatataacatgttaagaagataaataaaacatcaacactcatgttaacactgcaaatacacatgagagctttatactaagacggccatctcctccctctgacttatattttcctgaaggacatttacatagcataaatattttaaagacttttggctatttgatgacaccttgaacatatactttgaatctaagggaaaggagagtcatatttatctcctttctaaaacaattcaaatgtgatgtgtccctatttgctaagctgaaagtaagatgaagtcaaataaatggaaaatcaaatatttttaaacttctaggagctttttgtttgcttttttgttattttaataagagaaacaaagtaaaacatgtaaaaacacaaactctcacccagcatcctcttacgaaatacccaattttcaaataagcagtactatttgctctatttattactggtctttaagagaaatagacctaaaaaagaacatcttggaaggctagtgtactttcataattccctgagaagctcagtgattatgagtaatgtgaaccagagttcaatattcttacccttggaatcaggaaaaagaaagtcctttaaaagatcaagatctttgatagcagtaacaagaactaaatttgccaggggtagagccgtcctcttaccaatttcaggcaagaagcaatcttttcttgagtagcgaaaggcaagccaactaaagaaaaaatctgtgtgacttcaattacataaaattgactagatggttaaaaaacaatactttcacagaattttttctttctgtaaaactttacttgtatgttggttcttatttcattcagagatatattaagagcaaatgaaattgtgaaattattttcaaatacacaaaaaaagctcccccacgacaactttttctcaattgcctcttttgcctttcctcagttttatagtcttcagtgggtctccctcattgctccatattcctaagccaacaggaagaatttctttcagacccttaagccttgtgtctgttaccatagagacaggcatcacaaagtagctgctcaggaacatcctcatggaaatacaataagaatcctatgggttttacaggaatttccagcgctaccagtgagcagaaattatatctttccctagaaaaaaaatgtggggattttagttgcacattatggaactatggagattgtaatatttggtggtaaattcagaatccctcagctttatgcttagaatttgattatagtttctcctatgacatgaaaaaaaatcccttctcatatccctatgttcaggaaaatataaataactcattgctaattcttaaatttagcatgtcttatcaatcatttactaaaacccttaactgttcttttatagtgcagtgcatttgttttatcttgatcccttctagaacatatttgatcaagaacacactcataatgttataaaagtaagtctctaaaactgcaattccaaagctgctgagagagtctataaacccacgaagagagaagagggtagctgcaagaagaaaattccactcactttaccttgttttccattgactttcaccctttctgtaagtctactgaaatcatacactaacggaaaagcagcaataaaaataacagaatcctaccaaataggtaaattcagcaagattaatggagtcaaactaggcagatattatatataagtcaatgattgcagagacttcaattttttatggaaacattaaataaacattcctcaacaagtaaattatctcaatagactaacagccaaatgaaaccatctttatctgttaggctgcatatttgaactacttttccaagtctctagtacttaagtagtatgggtggttacaatttctgtttatggtatagaactgttatttaactgttacattgcttgtttagatacttgagtcaataagcaaaaaacaaaatttctttatagtctagagatgaggtgagcaaacttttcctatcgagggccagatagtaaatattcctgctttgtggcccacatggtctctgtcataagtactcaactgtgttttagcatgaaaggagtcctatatagcatataaacaaataaatgggtgtggctgtcttccaaataaactatagactcttaaattgaaattttatataatctcatgtgtcagaaatattcttgaaatgaaacaattcagaaacgtgaaaaccattttaaatgactggtcaaacagtaatagatgtgacaatgtggactatcatttactgacccctagcctggatgatgcgagtggagtagtagagaccctcagagaaataaatgtctaaaaaaaagaacatgtttttaaaagaaatgattggactcacagattcttagttaaaaattatctcagacatcttcttcaatttccatttagtgcagaaactccattcttagcactgaacactttaggaataaggagtgcagtgtctcacaaagtaatcaattctctgctcacaacattaactggaagaatacttttccattgctaccaaagaggtgcaagtgagtctaaaccctcttctgcattatagcacatcgaatatttgaaatcagcttaattttctctacttttttccttcaagtattcttcaacttttcacttttctagtactttccatgcccctcaaatgttatagtttgtaggaccttttagcattcagacacttttcactgaacatacccccaaatgttaaggttcctcttagatcatggtgtccttctaaaatatgtatatattaccacatataatatatacatataccatacctatcatatatatacacacacacaccattatatcatatatatccttctaaaattcgttctcatttttttcatttcctttttcaggatacatgtctaacaatattactttgtttcattgtattttgatgtcatatgaattatgactgataataatgatgaccaacaaaatcagtaagatttattcaattaattattactaagctttaactctctcatgtcctgtacttgccagattgattttatgaaccttagcttaggatgttatacttattcctattacaattattctctttgacctcaccacagtttttaggtggtcataatcctttggtaccctaatagttcaatgtatttgttctgcttcccagatagacaggctatctggatcgtccttcagtttttggacattaatatttcacaggccaagtaggttcaagaacagagacataaggcacattacagaagattaggttcaagtcagatggaaccaattttatagaactatgctatagtcctgtgaaaggccctcttcctggtttactgtgattcattaattgatacatcacaggcagggtcatttagccagctgatttattgaccagactcttatgtcaaacagcaaatatttctccattttcaccatatgggcatcataaaaatctttaccaaagtccatgctataatcaagataactagccatattacatacttttcagataacattggagaatcacagcatatattatctttgcactctttctaaaccatctcaccttcttcaggaattgtcagttactcccagtgaagaaaaaatattgcatatttttctggaaaaatatttccagttttaagtaattatttactctccacaatctaattatggactttccttcctatttttcactttagtttattaactccaggaccaactaaaatattgtcgtggctttctctttttaaacagttctgacttttttttttttccaaagcgtgtgtgtgtgtgtgtgtgtgtgtatgcacatgcttaagtggtttgtttttatttgctttttccttcttaaaagatggattatatgagaatgggaggataataggatggagcaagcttctcaggcaaaacatttcaaagcatatttcttaaccgatagtgtcttcccctgctcatctttctgaagagcaacacctgagaggcagctactctagctcatgtgggaaatttcacttgacagtcttatcacaaaaagagaaataagggagatttttttacttaaaaaataatgatgctcaataaaatttttacctaaaagagataaataattgttttagaatataaatgccttagagaaaacaatctgagtttgagagaattggggaaaactcacatagatttataaaagtcactaattctggatttaaaaatatattaaaatgtttgcagtctatttcattgtgtcccacttctctttcacaccttctatttttatgcatttctccttcatcgttttttcttccttaaagcacttcagaagacacaggattaagcaattgggatttgaagacttcacgtggtctcatcactctgcaggctgaccctgttttagagcaagaaatattggcagacatttccagctcttacaatgcatttatcaataagggtttgcctgctcttcaggtgcgtggcatatagactttacgatttcattaataatcaacagctggtgccacctagcgtctgtccaatccattcatcagtgggaccaaatacagagcactttctaaccgcaaatgaagcaagcctaaactataaactaaaaaatacaaaaacacagtttggggattccagtggctgatttaaagtacgctatcttcattgaaaaagaaaaaccttcttttaaaagtaactatggtaacaagagagtgaggctagaaggaagctcacattttttcgaaggagacaattcacaaaaggagagtcctactaaagatgcagtgtaaaagagtttttacagtcttgaatggtcacttaaaacggttataaaaagttgaaaagtaacattggccaaagagggctgtattttaaacaacagtatagacagagctgaattttctcaaccaaccacaaaataaccctgtagcatttggatgcaaaattctgtcagtctttgagcttcccaaagattaaccaagttctgtaacacactatacaaaagcatctacagtacttaaaagtattaaacggaaataatcagagtgcctgaaccacattataaaaaaaaattctttgctgctaaaatgatacatctagaaaactattttctttcctgctgtatatatgaattatgaatgatattcaaccacggtaatgtatgcttcaaggttaaaaagtagtcatccaaatccttgactatttttcaaaacagaagttagcaattattttggagaaatcctagtgtaattagcccaccacttgctaattaatttactgatatttaaatacatgttgtttttaactcaccctttctaagaggaatacgtaattgaaaaccatggactaacattcagaaaaaaagttacataacagccaatagtgttccttaaccagactgactgggatattacaattactacagaaaaggcacagcacatacgagtagcactgtgtacactgaaaggtcatattagatgtacatatatgatagtctattaacttggatgatttagctcctcaggctatggaggagactgggtagagagccgaaagattctgtattacatagacagttaataatcaggcttttcacacttaggaaaatctatttctatattatttaacatctgttttaaacaatcacttgttaaatgtttgaatgttttatttgcttgttaccctagtggtgataaagattatttcaatatgttcagtctgattacagtcactgacagatccccatgacagcatgtgaagataggttatagaaacgatgcatagtttatacaaaaagcataaattgctcccctttctccaaaaactttatttttggagccaaatactgtccatgctcatgctccatttgcttaaaagtacttataattataatccactgattgtaggggaaagaaatattgcaaaacagagaaagggttctaaaaatcgtacgcaggcaagaaagaatgtaagacaaaactcattaaagggcaaaataaataaataaataaataaataaataaataaatgctcacattttcaataatttatcacttctgtcatttttcattaacagccttcaaagccctatctgaaacaagctgatacagagaaattaagagcagtaatcaagcgagaaatcatagaccagctgggtcgacatcaacttggcaaaacgtgaatacagttcaatagctgaaacagatgctagagttgttgaaaaaccctgcaggagatattgatatattttcttcatataatgcagaatgactgaataaatgtcaaaagctagaaattgatgaggagaaatgactgacagccaaactccttataaaatagaaaccaagtataacaattttcaacctatccaaacattctgtacattctcatttctctcactgtctgaatatgccaatacatcaatcagttcttgcaactaaattgcatataactaatctggggtagatttccccgaagatttttttccccctgtcatcatctacctgaagaaacctagactcctgaacaatactttattctaaaatcttctaacactgatttctatcccagaagtgttttcctgaggttggaggcaagcacaccccctccccaaaatctaacgcagcacaaggcaattttaaaatccattctgtaaaagcaacactgtttgcagagtttgaagagctcggcaacaaaccccagctaccaacagctgcttgttcaaacatatgctttgtcatggccagcttctaattgtatttgtaatgatgtaatagctttaataatcctaccttccatgccagctgtttttcctgtcactccatcatgccaataagttggctgctgtaacaaatcaagatagtgcaaaacagcatctttctcctgattctgtcatcttcctgaaagcattctattactgccgactgctgggaaccagaaagtctatttgaattccaacagctcccctttcgcatgattcaagttaggttaggtgggcatgcctaacatgattctttcagtcatttattatgcagctgctacaacgtcggtgtggtaaccactctgactatctgatacgtcagtcgaacaaaacctatacctcggagcaaacacatgagccagagcagcgtttgcatttaacgagcattcttcctgcctaaaaaacagtggatctgcaaatctctttcagtatctactcgctcttctgtacagatgcaaagcctttggattagattattttcctaagtgtaacaatagtagagttcctcgccaaacatcatattattcacactgaaattttggctgatttttacttatcttcacagccttttaagggtaaaaactctcttctgaattgtacttttgcaataagatgttgtgtgctcagctccacatttctgcgttgtaaaatatagcatgcactttctcaaatggaatttgcctcttgtgactctatagcaaattttcaaataagaggatatttcaagaaaatattatttattttgcacactggagatatttaaagtctggcaccctgtatgcttctcccaagggtagactttatacttgatattttgactttagatgagtgatttcttcacaaagtaagaaattagattagctgaatctcttacacaacttctttaacaagtaaataaatgctattcaggaaaatgcattttgtattttaaaaatactaatcgtgaatcagtatttgttaaaagaaactgtaattgttatcaattataccgtataattttctctaaaacttccaagtttgcctgtcttgggggcacttatggtttgaaattataacacaagaaagtttaagtgttttcatgagaaaaattaataaaatcatatgtttcctctcagatttgtattaggtatttagtttgttaggaaagctatcccccctaccacaaaaagtaaacagacagctggtttcatagttacattatgaaactataaggaataactcatttagcatatgtgaaatatgccaatatcgctattctgaaatagtgttttcctaaggggttatggtgtgtgtgtgtgtgtgtgtgtgtgtgtgtgctttgtgtgcaagtactcatacattttagctattctacttccatttgatttttgtataacaaacacaaataatccctatatatcaagatatacacaacaatcagtaacttatagtttattagatataatttataaatgcaagaaataaacctgaaagataagttgagtccatatgaatccaccaagatttctctaaaataatatacatatcattccacacaactctgaaaatactggtatatcaattactgctattttacataaaaagtcttcggtgattagcatatctattttagagattgagaatagcataaatgccatgtgttttttttgttgtattcttggcttctactagcctctccagcttaaactcttgcctctcttcctctttatactttattccagccacaatggacttctattttttcttctaaaatgctggactccttcctgtttcagatattttccgtattctgtttcatctattcataagtctgtcttgaggcttgtgaaaattaattttttgtaaaaatgtatacaagttgtacaacatgtttcaatatacatatagtgaaatgattactacagtaaaagtaattaacatatccatcctcttacatggttaccctttttttgtgtatttggtgataacactcaagattactctcttagtgcatactgtagtgttattaactatagcccctatcctgcacattagatctctagaacttattcatcctgataatgaaaactctgtgtcctttgaccaatatcttcccattctccccctccctctgcccttggtaacaatcaatctaccctctgcttctttatagctgactgttcagattttacatgtaagtgagatcatgcagtattattcttcctatgcctggcttatttcacttagcgtaatgttcttcaggttcacccacattatcacaaatagcaggatttccttcctttgtaggctaaatattatttcattatatttacatatatcacaatttctttattaatttatctgttgatgtacactcaggttgttttcatgccttggctattgtgaataactctgcactgaacatgggagtgcagatatctcatctagatactgatttcatttcctttttatatatacccaaaagagtggtaatttgatcctagggcattcgtattttaactttttgaggaatctccatactgttttccataatggctatacaaatttacattcccgccaacaatgtataaggattcccttttatccacattcttgccaaaacttgttattttttttatctttttgataatagccatcctaacaagtttgaggtgatatttcactgttgctttaatttgcatttccttgatgattagcgcttttgagaatcttttcatatacctgttggccatttgcatgtcttctttggagaactgtctattcaggggctttgaccatttttaatcagattttttgttttttgtttgtgtgttttgcttgagctctgagttcctcatatattttggatgaaagctgcatattggtcatatggtttgctaatatattctcccattccacagttgtctcttcactctgttaattgtttcctatgctgtacagaaggtttatggtttgccgtagtacaacttgtttaattttgattttactgtctgtgcttttcatgtcatatctaaaaaatcattgccaagaccaatttcgagaatttattttttcatgcactttcttctaggaattttgtagtttcaggtcttacatttaattctttaatcaatttttagctgacttttgttgtgtgatgtaagggtccaattttattctttagcatgtgtatatccagtttttcaaacaccatttattaaagagaatatcctttcctcatagtgtactcttgttgcccttctcaaaatttagttgaccatatatgaatgggtttatttatgggccctccattctgttgcattggtctatatgtctgcttttatgccagtactatattattttgattactaaagctttgtcatataattcaaaatcaggaagtgtgatacctccaatgttgcttatccttctcaagattgctttggctattctctttcttttgttgtttcatttgaattttagattttttttaaatctatgaaaaatgctattggcattttgatagaggttgtgctgaatctgtaaattgctttgagtagcatggacattttaacaatattaatccttctagtccatgaacacagaacatacacccatttatttgcgtcttttaaaatttcttaaatcaggccacgcacggtggctcatgcctgtaatcccagcactttgtgaggccgaggcaggtgaatcaccttaggtgaggagtttgagaccagcctgactaacatggtgaaaccccgtctctactaaaaatacagaaattagccggacgtagtggcgggcgcctgtaatcccagctactcgggaggctgaggcaggagaatcgcttgaacccggaagatggaggttgcagtgagcagagatcccgtcattgcactccagcctgggcgacagagccagactccgtctcaaaaaaaaaaaaaaaaaaaaaatctttaatcaatgctttgtagttttcactgtataaatatttcaccattttagttaaatttattcctcttttattcttcctgatgatactgtaaatgaaattgttttctaagtgccattaacagataaatggataaaaaagtggtatatatatatatatatatacacacacacacaacggaacacacaacggaatattcatttatataaaaaaaacttaccatttgcaacaacatggatagaactgaaggacattttgttaagtgaaataagccaggcacagaaagacaaatattacacgttctcactcatatgtgggagctaaaataattgatctcatggaggtagtgagtacaatagtggttacgagcgtctgagaagggaagtgaagagaaggggatgaagagaggatagttaatgggtacaatacaaaagtacagttagataaaagaaataaattctagtgtttgagagcatagtagggcagctatagttaacatgaatttatagtatatttcaaattgccagaagagaagatttggaatgttcccattacaaagaaatgataaatatttgagatgatggacatcctaatcaccttgattcgatcattacacattgtatgtatatattggaatatcacatgtaccccataaatgtgtaatgtatcaataaaaagctaaatctaaacattttattgatttccttttcaaaatgaaatcaactgatttcatttttagagaaaagaaatgctaccaatatttgtatgttgattttgtatctagcaattttactgaattcattgattagttctgacaaatttttaatgaaatcattagggctttctacatatagaatcgtggcatctacaaacagataattttacttcttcctttccaattccactgccttttatttctttctcttgcctaattgctctgactaggacttccaatactatgttgaacagaagtgttgatcatgggaatccctgcattgtaccagatcttagaggaaaagctttcaattttttccccgttggttacaatgttagctatgagtttttcataaatggcctttattatgttgatgcaagatcattctacacttattttgttgacagttttcaatttacccatgaatacatgttgaactttttcaaatggttttttctgcatctattaagatggtcatgtggttcttgtcttttactccgtttatgtgatatatcacattgattgatttgcatgccataccaaccttgcatcttggagataaatcccacctgatcatggtatataatccttttgatgtactgttgaatttgttttgctagtattttattgaggatttttggatctatacacatcagagttaccctcctgtagtgttcttttattgtggtatctttgcctggctttggtgccagtgtgattctggcttcataaaatgagtttggaagtgtttcctcttctcatttttttttttttttttttttgcaagagttaaagaagaattggtattaattatttttgaatgtttgatagaataaatctgtgaaggtatctggtccagtggttttctttgttgagaaatttttcattactgcttcaatctctttgttaatggtctgttcagactttctatttcttcttgattcagccttagtaagttgtacgtttccaggaatttatcaatttctagactatctgattttttaagacatagctgctcataatagatcctgatgatccttattacttctgaggcatcagctataacgtctccccattctttatttcagtctttcttttattcttagtatatataagggtttgctgattttatcttttcaaaaaaccaaccgttagtttttattttttatattgtttttctattctctatttgacttacttctgctccaatcattattatttacttccttatactaactttgggcttagtgtcttctttctcttctagttccttgaggcataatggtagattgctgatttaaaatcattctttttaaatgtatatgtttagagctataaacgtcctcctcagtactgttttttctgcattccataagttttgatatctttttaacattattttttgtctgaagatatttcttaaatactcttctaattttctctttgacacaatggttgctcaagagtgtgtggcttagtttctatgtattagtctattttcccattctcttgctgttactgatgtccagtttcattccactgtggtcagaaaagatacttggtgtgatttttatatgcttaaatttatttattaagagttatattgtgagcatgccctctttaatcaattctgttcaacatagcaccggaagtcctagtcagagcaatcagacaagagaaaaaaatgagtggcaaacaaattggaaaagaagtcaaactgttgttgtatgctgataatatcatgtacctagaaaaccctgataaacaaattcagtaaaatttcaggatacaaaatcaatgtacacaaatcaatagcactgctacacaccaacaatgaccaagctgagaatcaaatcaagaatccaaccccttttacaacagctgcaaaaaaaaaaaaaagcaaaatgcctagaaataaacttaaccaaagaggtaaaagttatctacaaggaaatatgcaaagcactgctgaaagaaatcatagatggcacaaacaaattgaaacatcccatgctcatggacaggaagaatcaacattgtggaaatgactatacagccaaaagcaatctgcagattcagtacaatcccatcaaaataccatcatcattcttcacagaactagaaaaaaatcctaaaattcatattgaacaaaaaaaaagagcccacaaagccaaagcaatagtaagcaaaaagaacaaatctggaggcatcacattacccaacttcaaattacactatgtggctacagttaccaaaacaatggtagtggtatgaaaataggcacgtagaccaatggaacagaacagagaacctagaaatgaagccaaatacttatagccaactgatctttgacaaagcttataaaagcataaattggggaagggacaccctattcaataaatagtgctgggaaaactagtaaaccacatgtagaagaatgaaactggatccttatctctcaccttatacaaaaatcaactcaagatgaatcaaagacttaaatctaagaccttaaagtataaaaattctagaacataacatcagaaaaactcttctgggcattagcttaggcaaataattcataactaaggcccccaaagcaaatgcaacaaaaacaaaaataagtaaattagacccaattaaactaaaaagcttctgtatagcaaaagaaataatcagcagagtaaagagacaacccatagagtgggagaaaatcttttcaagctctgcatccgacaaaggactagtatccagagtctatgaggaactcaaatcagcaagaaaaaaaagtctcatcagaaagttatcaaaggacatgaatagacatttctcaaaaggagatatacaaacagtcaacaaatacatgaggaaatgctcaacatcactaattatcagggaaatgcaaattaaaaccacaatgagctgccaccttatttctaaaagaatgaccataattaaaaagtcgaaaaacaataaatgctggcatggatgtggtgaaaagggaacacttttaaactcctggtgggaaaagaaattagtacaaccattatgtaaaacagtatggagattccttaaagaactaaagtagaactaacatttcattcaccaatcccactactgggtatctacccaaaggaaaagaagtcactatatgaaaaagacacatgtgcagacatgtttatagcagcacaattcacaattgcaaagatatgaaaccaactaagtgcccatcaaccgagtggataaagaaaatgtatatatacaccatggaatactattcacccacacaaaggaatgaaataatggccttcgcagcaacttggatggagctggaggccattattctaagtgaagtgactcaggaatagaaaaccaaatatagtatgttcttacttataagtgggaggtaagctattaggacacaaaggcataagaatgatgtaatggactttgggaacttagtggggaacgttgggaggggattgaggggtaaaagactacatattgggtacagtgagcattgcttgggtgatgggtgcactaaaatctcagaaatcaccactaaataacttatgcatgtagccaaaacccacctgtaccccaaaaataattgaaataaaaaaaagttgtgttgtgacttaacatgtaatctatcctggagaatgttgtgtgtgtgtgtttgagaagaatgtgttttctcctactgttggatggaatgttctatgtatgtctgtcggtccatttattctctaattttgttcaagtacactctttattaattttccatatgaatgttctgtacgttattaaaagtaggatattgaagtctcttactaatattgttttgctgtatatttctcctttcagatctgtcagtatatgcttcatatacttaggtgctctgacagtgagtgcatatagatttgctcttgttatatctttcagttgatttcacccttttattattatataataacagtctttctctagagtttttgtttaaacttaaagtctattttgtgataaagtatggccacttctgcttttttttttttttttttttttgagacagagtctcactctgtcacccaggctggagtgcaatggcatgatcttggctcagtgcaacctctgcctcctgggttcaagcgattctcctgcctcagcctcccaggtagctgggattacaggcgcccgctaccatgtctggctaatttttgtgtttttttagtagagatgacgtttcaccatgttggccagactggtcttgaactcctgacctcaggtgactggcctgccttggcctctcaaagtgctgggattacaggcatgggccaccatgcctggcctactcctgctttcttttggtcactatttccatggaatatatttttccattccttcactttcagcatgtgtttccttgaatctaaaataagtttccttagacaacatatatttggatactttttaaaattcatgcaggcccactatattttttgattggggagtataatccacatttatttaaagtaattattgatcagaaatgacttgatattgccattttgaaattttatttttatttatttatatgtttttgtagagacagggtcttgctatgttgtccaggctggtcttgaactcctggcctcaagaaatcctcctgccttggcctcccaaattgctgagattacagacatgagctaccacacctggcctgactattgccattttgttatttgtttttcatgtagtaattttgtccttttttctcttgctgttttccttcatgatttgctgttgttgtttttttgcattgataggctttgattctttcctttttttcttttatgtaacaatgataggctttttctttgtggttaccatggagtttacataaaatatcttataataatctatattcagctgatagcagtttaacttcatgtacacacaacaactccagacttttacctctccttccccattttatgccagtgataaaacaattttcttgtatttattttatgtatccattaatgttatctatttatggttatttttaatacttttgacttttaacttttatagtataattaaaacaatttacccaacactgttatagtaatacagtattctgtttttctctatgtatttacatttaccaatgggttttatactttcatatgctctagtgttactgtttagtgtctgttaatttcaatttgaagaactccctttagtatttcttataaggcagttctagtgctgcaggacaccctcagcttttgcttgtccaagaaaatctcttgccatcgtttttgaaggacaagtttgctaaatatagtatttttggtagacagttttctttctcttctggcttgcagcttcccctcacgtttgtctaccttccatccaatctttaggtataatcttgaaatataattttctgtgcgaggcattattgatccccagataaaattatattctgctacgcaatttcacagcaccttgtatttcctctatcttcataatagtaatggcatatactatacaacatgggggaataggcactgttataaaattatatacgcacaaaacatatgtgtgtgtgtgtgtcactttgtctatccatccgtctacctatctacttatccataattcatttatatattctcattaaatccttactctgaacctatgagggcgactcttacatgcattttatagataaggaaactgaggcacaaaaaactttaaaaagttggccaagtctaccttctcagcacagtaggcagcaagtcagtcttgtaaaaacctggccaggccacacaactttatttaattgtttgtatttcctggtatactatcagttctcgaaactggatattatgtttgtcttgttaattgctaaatcctaatgtctaggatggtacccgaaaagttgtgtttcatgaattcacttatccagtagaacttgctttatgaaatgttctgtactaagcactgttgatatggagatgattaaaataaacatggattctgtgttgctggcatttgtgaactagtactaaactcaggtccaagggttcatagacagaactgagaaatgttcattgggatgaaagaaatactacatctttattttcatcaatgtctcattaaaatgtagcagtatttttatttatttttgtaggttataaaccatagtagtattagaagtacctgtgacttttgttactaaaaggagtaacaaatatttcatatcattttatagaagctgtataaatcttaaaatatttttacattcatgactactttggcattatggttgttattaagcccacaaatatatattgttatttaatgtgttaataaagaagtatgcatattattatattacaacttttaaatctttagaaaaccgtatttcgatacaactagtttctgttgtaatcctaaatgttttatcttgcatatgtaataaaattcagacacacttcacaagatgtgaaaggctttaaaggaacaggtctttaaatttcaccacatgtcaaagaatccctggtttaggggataggagaatatagcattttagaatccctggtctaggggataggagaatatagtgtatttttaatagcactgtctccatagtcagactacttgggttcaaattattgataggtgacttacaattgatgtgttctatggcaagttacttaacctcagtttattcttctgtaaaataggaataataattgctcctttgcattcttgtgataatacattaagaaaatgattgtaaaatacttagtataatgcctgacatctatttcacttttaataaatgttacatatcattagcaagagagttagatactaaagggttatgaaaaataagattataaaaagaaatacaaagtattaacaaagatttttggaactggaactcatatacactactgatggaaatgtaaaatggtaaaaaactactctgaaaaatagtttggcaatttttgagaaacctaaacgtatacatactgtaagagtcatgcttcctacttgaaatgaaagcatatgcccatacagatttatccaagagaaaaagaaagcattagccaccataaaagcttatacatgaattttcatagcagctatatttgtaataaccctaactgaaaatgacccacatgtttaccaatgtctaactggataaataattgtagtatatctatataatgtaatgctactttgccatggaaaggactggaaacttgatgcatttaaccatgtaaataaattgcaaaacaatgatactaactgaaggaagccaaacaaaaagagtacataccgtatgctttcattcatacaaaactctagaaaatgtaaatatatctgcagtgacaataagcatatcagtggctgcctagggaaggtgggggtgatagatgaggaggaggagctacaaaagggaaactttttggataatagatatatttactatctttgttgtagtgatggtttcatgtatgtgtgtgtgtgtgtgtgtgtatatatatatatataacattttaaatatgtatggtttattgtatgtaagttatacctaaaaaatcctaaaaataacacttaaaaaactccttttattatattttagagtattcctattaatttaacaaaatagttaaaatataacaatcacttccttaaaagataatctacaaaacttcatatagaaataatgcatgcggtaaataattttatcaactgcatataacgctgaacatcccaacgaaataatttttctcaccacttgttatttgcagttctttatgccatcattgaacaatgttgcaattgattattgtccaataacaagagtataattttgtcccatttaacatatataattttatctattgtgagcacctaagccagtaaaataaattattagtctggttataaaatggtcagctgcataaaatctaaggtattgatcaatattagcttgttgccatataattctatgttatgtgaaaccttggaataagcttcctttgttaaacaatgattaaatgttgaataacttgattttataagttatccttatttcacaacaatggataccatatcaaactcaatgattatttaggggagaagaggactaaggaaaagtcaggcactgaaaataataaaatttattcacccataaaattttctcacatggcattttaaatatgttaatatatttttaaaaagccagataactaaacttataaaaattatcacatctgtgaagttgtagttggattaaggaaaagtagaaaatcctggccttattattctattttaacactcactccctacccagcctaaatcagccaaaggatatttttaaaacacagatacacataaaatatcagattatgtctctgtctcaaatctcttcagtggcttctcaatacctttagaacaaaagtccttactatagcctgtaagatcacaaataatatgtccccttactttcctttttttttttttttttactttgctctaatcccactgatagtcttatttctcttctaacttatgaaacttatttccccttgggacatttcattaactcttccttcctaccaagaatatccttccgcagatattgcaagactcacttctttctttgtagtctctgcaaaaatgtcacctcctcagaaggcccattttttacttgtgtctttaacacttccatgaccttgatccatttctcttttttttgcttcacttttcctttcagcacttatcaccacctggtatcaaattattaatcagtcagcccagtgattttctctctcggcagaatacaaactccatgatgggtgttccatcgtatgcctcattcaccgctccatctctggcatgttaaataaaaataacaaaaccaaacaaaaaccaaccaaccaaacaaaagacatttggcacagagtcagcacaaaatgaatatttgttaaataaatgaatggaaaaatagttaatatataggattactgttattatttggcttccaataggtgactttagaaagctgtctatactcacaggtttttctcacaatatacgggaatacatgtttccactggaaataacagaagttactgtaaaaaatcgaggaattttcttccagaaaactatctagacaggacctaatatactaagtttattaggtctctacctacaacaatatttcaccaccataattattacaagggaataactaatatatgatattgtgaatcacctatctattaatttgcacacatttattaagcacttattttatgctagacacttttctgggtgttgggaataccactgtcctcgtagagtttgtggttttgtgggatagatagatattagacaaataaaagtctgataagaactaggggcatcaatacagaatttttagaagcatacagttatagggctaattttatcatagaaaattcttcttaaacgtacaactaaaggataaataataattgcatgggtcaagagataaaagcagagagtactataggaagaggaaataaagcaggaaaacattcaaaaactgaacaaagtcctccatgcctggagcatggtgaatgtgggggagagtgaagcgtgatgaataagattagggtctcaatctaggtagttgtagattatgtggggcttctcttctttgttagcaatggtaaagatcctggagtttattgtaagtacattggaaagccacttaaagttgttaagtcaatgagttacatgactaaatttggtaacaaacataagcgtgaatgtactggtaagaatgaattaaaatgaggcgggcagtaattctagatgcacataggcttgttaaaagacagtttcagaatatcaggaaatataatttgactagattgctagcaaagaagatagaaagaaatgatgagattccagagatgttaagaagggagacttgatagaacaaggtgattgcttcgaaattgaggagggttcagggatatgaaggagtaagcatgtactttcatgttttcaacttgagcaattaagagaatggtggtgtattttctggaaaagccaggttggaaagggaatgatggcttcaattttgtttctgttgagtttgcgatacttgggagacctttaagcaaagatgtacaggagaacacagatattagggtctggatttcagaagacataaacatttaagatgtggcagtgtttgatggtaaatgaagccatatatctggacaaaataaagacagagtaagccaggagaagagacaagagcctaggatggcaccctgaggaactctaacaattaatgcttgggtagagaagaatgagattgtcaggattttgagaaggaatgttcagagaacaagaaaaaaagtaaatagatatggtgctatggaagttaaggggatagaaatttaaagaaagaggaaattgtcaactttgtcaaatatggttgggagatacttctttatctgcatgttgttttagttactggaagagatacattaagatatccaatatgattgttgatttgtccagatctctatttagctgttaattttgctttatccattttgaaggtacattattaaaattgtatttttctatatatcctattgattcgacccattttttcaaggtgaaatgctttgcatctcttattatatttcttgcctgatactaatataaacaaattaatattttgggggttagaggttacatgcatctggagacctatctgtgtcattataaagtagttttattctaaacaacccagggctgtttttttttttctcagtattacaatttttgtattttaaccaaagtgtttaatatataatctatcatcttgttattttctcttcatcctatttttttctttatttttctactctaccatttttgctactcttaattattttacttctacatatagtggataccctacattcattgctattattgtttctttaaacagtcagttgttttttatatttaccaatatttttactattcataagaagctcatttatttttgcatgtctgtttttcatccactaccattttccttcaatctgcaaaatgtgttttagaaaatacattggtgtacaactactggtgtgatggttaatattgagtgtcaacttgaaaggattaaaggatgcatagtattgttcccgggtatgtctgtgagggtgttgccaaaggaaaggagactaacatttgagtcagtggactgggagaggcagacccatcctcaatctgggtgggtaccatctaatcagctgccagcgtggctagaataaaaacaggcagaggaacatggaaggcctagactggctaaatctcctggcctgcatctttcccctgtgccaggtgcttcctgtccttgaacagcagactccaagttcttcagcttttggacccttggacttacaccaatgatttgccagtggttcttgtaccttcagccagactgaaggctgcactactggctttcctatttttgaggttttggacttggactagcttccttctcctcagcttgcagacggcctattgtgggacttcaccttgtgattgtgtgagtcatttctcctaataaactccccttcatatattcatttatcctattagttctgtccctttagagaaacctgactaatacaactagtgataagttatctcagcatttggataactgagactatctttattttaccttcatttaaaaaatactgtctattttgcatgattgcagatttgtatgcagttgtaagaaataatacaaaaagatcttttttacctttcaaccagtttctcccaatgataacatcttgcatagttacagtacaatatcacaaacaggaaattgacagtgagacaatcttattcagattgctccagtttcacatagtcatttctgtgagtgtgtgggtattattttcaaagaaattttatcacatatatatgttgggtgactaccaccaagttccatcacaagaatcccttgtgctaccctttcactgtcacaaacacttcccccttaatttctggcatctaaagaagctagaaaaaggagagaaacataaatccaaagcaagaaaaaaggaaggaaacaataaagacaagggcagaaataaaaaatgttgaaaatccaaaaaccatagagaaatataattgaaacaaaagatggttctttgaaaaaaatcaatacaattgataaactcttagcaatagtgacaaagatcaaaaagagacaagacgcaaatcatcaataacaataatgaaacaaaagatatcactgcaaatcttaaagctcttaagaggataataagataacactatgagcaatgttacactaacaaattccacaaattaaaagaattggaacaagtccttaaaaatcagaagctaccacaactcagcaaagatgaaagagagaacatgaatagtcttgtggatattaaaggaattgaatgcattaatttaaaatctgcagaataaggaatttctaggcccagatgatttctctggagaattctaccaaacacttgaagaattaggccaagactggatccaagatggccagctagatgcagccagaagaaacattttccattgagagactgggatatcaagaagattggcacactcctagcagatcatcagagtaaaggtattgagagcaaacagagggaagacacagacactgggatgaaggtgaaggaagatgggaaccctgcacagggctactgagcactgggactcattcctggcacccaacgactcctgcggagagagtgagttgaacaggcaaggagcaacccgctattgccatataggcctctggaattctggcaggaggagactcctcgaccactacggacacttaagttatcagggagagctgcttagagacgtggtagaggcagaactccagccgaggtggagcccaaaggatttggtgcaggagcatctgcagcggagcacggccaggggcacccatccccctaggctctctatgttcccataggagactttagccctagaagaactgtcagacctgaactctgtagggtggtcttgcccatgagaccgggtggtctgacctgagcacgccttagtcagttggcctctcccaggacctgcaacctggccatgcctgcatgcagtgcagcccccaggtacttcctgggggcctgtatcatagctcctgcactggcagaccgcgccttaccagcagagtgcttcagcaaagtggcctctggacacacacaagcccgcctgcaccctcctgcactgcagcctctccgatgctactttgcctgcaagcactcacccatgcccacccccacatcacagtgccagcatgtatgtgtgcaggtggaccttgatttctcttccttgttagtgcacgtgtgtgtgtgtgtgtgtgtgtgtgtgtctgctgtgccactgctgccagcatgagtgcaccccaccctcgctgtcactgctgcaccgccattgtcactggagtactggtgagcatcaagcctaccagacctacccccgccagtgctctgagcctatgctgacactgctgctggtaagaaaccaggcgcacaaaaaagaggacttgcccccggccctaagtgaccgccactgccagtgtgaatgtacacagagtgtgcacacagtactgtgcccaacagcaccctgtcctcatactaacaccatgatcggtgcaaatgtatgcacatttgccagaggggactccctgcccctccaagccatactgctactgctgctgctgtgatgcctgcagagaggccagcatccttgcactcactagcaccctgccactgccaaggaatgtgcattccaccttgctgctcctgccactgctgccagcacatacaagtgaagacagatctcaggacactgcccaatgaagtgctttggctggcaccacccattagggcgttgtgatgagaagcctgggagcacttcgccccctccagcacagcaagttttaatctcaaggaaccaaagaacaaaactgggtcccaatactattctcccagaattagggcaagcagtccaggagtcctgagctgagccttggccccttaaaatcttctaataattaagccagttgactgaagaaatcttatacaacaatcaaaccccaaagggcaccaaatgggataaaagaaaaaaaatccaaagaacagcaacttcaaagattgaaggaacattagcccacaaagatgaaaaagaaccagcacaagaactccggcaactcaaaaaaccagagtgccttctttcttccaaacagctacactagttcttcagcaagagttcttaaatgggctgagatggctgaaatgacagaaatataattaagaatatgtatagaaatgaagatcatgaagattcagaagaatgttgaaatccaatccaaggaagctaagagtcatgaaaaagtgacacaagagctgacagacaaaatagccagtatagaaatgtacgtaatcaaccttatagagctgagaaaacactctacaagaatttcataagacaattgttaagtattaacagcagaatagaccaagcagaggaaagaatcttagagcttgaagactggatttgtgaaataaggcagtcagttaagaataaagaaaaaaaatgaaaaggaacgacaataacaaaacattccaagaaatataggattatgtgaagagacaaaatctatgactcattggcacccctgaaagggatggggagaatggaagcaacttggaaaacatatttcaggatgccattcatgagaatttacccaacctagctagagaggccaacattcaaatttaggaaaggcagagaacccccacaacatacttcacaagaagatcatacccaaggcacataatcatcagattctctaagggcaaaataaaagaaaaaaatgttaaaggtagctagaaagaaaggacaggtcatctgtgaagggaagcccatcacactaacagaagacctctcagcagaaactctacaagccagaagagattagggacctatattcaacattcttaacatgaagaaattctaggcaagcatttcatattcagacaaactaagctttataagtgaaggaaaaacaaaatcattttcagacaatcaaatgcagagagaatttgttaccagtagaccttccataaagagctcctgaaagaagcactgaatatagaaagactgttaccagccactacaaaaacacactgaagtaaacagaccagtgacactacaaagcaaccacatgaataagtcagcataataaacagctaacaacatgatgacaggatcatatccacacatatcaatactaaccttaaatgtaaatgggctaaatgctcaaatcgaaaggcacagaatggcaagctggataaagaagcaacacccaaaggaatgctgtcttcaaaaaacccatctcacatgcaatgacacccataggatcaaaatacagggatgaaaaaaaatctaccaaggaaatagaaaacagaaaaaagcaggggttacaatcctaatttcagacaaaacagactttaaaccaacaatgataaaaaaaaaaagaaggacattgcataattgtaaagggttcatttcaacaagaatatttaactatcctaaatacatatgtatccaacacaggagcacccagattcacaaagcaagttcttagagactttcaaagacacttagactcccacacattaatagtgggagacttcaacacccctctgatagtattaaacagatcaacaaagcagaaaacatatacatttaagacctaaactctactgtgggccaaatgtttctgagagacatctacagaactctacaccccaaaaaacagaatgggctgggcgcggtggctcaagcctgcaatcccagcactttgggaggctgaggccggtagattacctgaggtcaggagttcaagaccagccagaccaacatggtgaaaccctgtctctactgaaaatacaaaattagccgggtatggtggtgcatgcccataatcccagcaactcgggaggctgaggcagaagaattgcttgaatctgggaggcagaggttgcagtgagctgagatcacaccaccgcactccagcctgggcaacaagagcaaaacttcatctcaaaaaataaataaataaaaaaaccagaatgtacattcttctcatctgcatatggcacatactccaaaatcaaccacacaatcagacataaaataatcctcagcaaatgcaaaagaaccaaaaccatatcagctactctctcagaccacagcacaacaaaaatagaattcaagactaagaaattactcaaaaccatacagttacatggaaattaaacaacctgctcctgaatgactcctgggtaaataaagaaattaaggcagaagtcaggaagttctttgaaactaataatgagaacaaaggtataacataccagaatttctgggccacagctaaggcagtgttaacaggaaaatttgtagcactaaatgcccacatcaaaaagttagaaatatctcaaatgaacaaccaaacattacaactaaaaaaaaaaaaactagagaagaaagaccaaaccaaccccaaagctagaggaagacaagaaataatcaaaatcagagatgaactgaaagagactgagacatgaaaaaccatttgaaagatcaatgaagctaggagctgggtttttttttgaaaaaaaaagacaaataaactgctcactaaattaataaataagaatagatagaatatccaaataaacacaatcaggaatgacaaatgggatattaccattgaccccacagaaataaccatcagagactattatgaacacctctatgcacagaaactagaaaatcaagaagaaatggatacattcctggacacatacaccctccaaaaattgaaccaggaagaaaatgaatctctgaataaataacagacaaatccctgaacagacaaacaacagataaataaagagatccaagaatgaattgataataagtaagcaacctgccaaccaaaaaaaaaaaaaacaaaaaaacaaaaaaccaaaaacccaggaccagatggattcacagctgaattctaccggaagagctggtaccattcctactaaaatgattcaaaaaattaaggaggagcgactcctccccagctcattctgtgaggccagcatcatcctgataaccaaaacctggcagagacacagcaaaacaagaaaacttcaggtcaatatccttgatgaacatcatgcaaaaattctcaaaaaatactaccaaactgaatccaagaacacatcaaagatctcatccaccacgatcaggtaggcatgtggctggtgtataggaattctattcatttttgtatgttgactttctattctgaaactttgctgaagttgtttatcagcttaggaatcttttgggccaagactatgggcttctctagatatagaatcatgccatcttggtatatgtttcatgggcacttaaaaagattgtatattttgcagttgttgagtattctaaaaatatcaaatagaacttgttggttaatggtattgctaagtttttctatatcctcgattcaatgatatgcctatgaaacttaacattggcattcttcacagaactagaaaaaactaatttagaattcatatggaagcaaaaaagagaacaaagagccaaggcaatcctaaactaaaagaacaaaggtagaagcatcacactaactgatttcaaagtatactacagggctatattaaccaaaaccgcatggtactggtacaagaacagatacatggaccaatggaaccgcatagagaacccagaaataagaccacacaccaacaacaatctgacaatctaggcaataccactcaggacataggcatgggcaaagatttcataatgaagatgccaaaagcaattgcaacaaaagcaaaaattggcaaatggaatcaattaaactaaaaagtttttgcacagcaaaataaactatcaacagagcaaacagaaaacttacagaacggaagaaaaaatttgaaaactatgcaactgacataggtctaatataaagcatctataagtaatgtaaacaaatttgcaagaaaaaaacaaacatctctataaaaagtgggcagagaacataaacagacacttttcaaaagaagacatacacgtgaccaacaagcatgtgaaagaaagctcaatatcactgatcattaagggaatgcaaatcaaaaccacagtgagattccatctcacaccagtcagaatgactattattagaaagtcaaaaaatatctggtgctggtgaggtttacactgttgtaaaggtgtttgctctgtgggttggaatgtaaattagttcaactaatgtggaagacagtgtggcaatttctcgaagacctacagtcagaaataccatttgacccagtaatcccattactgggcatacactgaaaagaacataaatgattctattataaagacacatgtactcacatgtttattgcagcactgttcacaatagcaaagacatggaatcaacctaaatgctcagcaaagatagactggataaagaaaatctggtatttatacaccatggaatactatgcagccataaaacagaatgggatcatgtcctttgcagggacatggatagagctctaggtctttattctcagcaaactaacacagaaacagaaaatcaaatactgcatgttctcacttataagtgggagctaagtgatgagaacacatgggcacgtagaggagaacaacaggcactggggcatatcagaagttggaggttaggaggagggagaggaccagcaaaaataactaatgggtactaggcttattacctgggtgatgaaataatctgtacaacacacccccatgacacacgtttacctatgtaacaaacctgcacatcctgcacatgtattcccgaacttaaaagttaataataacaataatctccatttattagtggatataattggttaaagtaattattacattagagggcacaatgaccaaaactaagtggaacaataatgtcaagtaagtttgtagttaaagaatgtaagagctccccgcctgaaattgtcatagaagaccaaacaacactggaccaattttaggaccccgaaagactaatgctagtagcctcaacgtgcttagtagtagatccaggaaggggaaacaccatatgacggcctctaaaggaaaaaataataagcagaagagagggtgaatacaagcaaaacaaaagttttgcctctggtattctttttttttttttttttttgagatggagtctcactctgttgcccaggctggattgcagtagtgcgatcttggctcactgcaagctccgcctcccgggttcatgccattctcctgcctcagcctcctgagtagctgggactacaggcacccgccaccacgcccggctaatattttgtattttgttttagtagagatggggtttcaccgtgttagccaggatggtcttgatctcctgacctcgtgatccgcctgcctcggcctcccaaactgctgggattgcaggcgtgagctatcgcgcccggctgcctctggtattctgacataccatcttatggagcatagcagttgacaataaacagacaacgtgagataagaagcatgttactttttgtgctccagtcaattaaagtagaatgtgatataacaaatggcaaagctcatctataagaaactgagagtcattagtgggatggggagtgtgggaattccagatgcaaagagcattcccttcttccccaattcataaataagataaaaataaaaggtgaaagtaatagagaaaagttaggtctaaaccaaactttagaaaaatcacaagggctgtcataaagttcagtaatatttgacaatattctacagaaacctagagtaatggttattttacaaattttacttaaaattagagggtaagcgattaagcaaatttatttcagaggaatgaataaaattggcagagaaatagactgataaaatgattgctttatagaagcaacaaaagattaggaactaagatctttggtcccttggtttgtcacttttattaactagttgtggaatttaagcatagtacctcatgtattaaatacatcttgggactcaaaggaatgcttgttttccatgactcattttttggggagaattttacaaaactaggatgagaatgaactttgagatggataaaatagccttttctttttttttttttttttgagacgtagtctcgctctgtcgcccaggccggactgcggactgcagtggcgcaatctcggctcactgcaagctccgcttcccgggttcacgccattctcctgcctcagcctccccagtagctgggactacaggcgcccgccaccgcacccggctaattttttgtatttttagtagagacggggtttcaccttgttagccaggatggtctcgatctcctgacctcatgatccacccgcctcggcctcccaaagtgctgggattacaggcgtgagccaccgcgcccggcctaaaatagccttttaaagttagtagtactttatagtaatattaaagataggatacgcaggtagaaatttaaaacatatcacatgtaaagttgactttaaagtgaggaaggagtccttgtgctttgtcgtcattggttataaatggactgtttcatgtgtttctttactttctttgtggctacagtatactattataaaaggcacaattttatttctttgtcacttcaaaactaatcctcttaagtgccaaagtataaagtattagctatctattttattaattcataaatatcaactgttacaggagaattaaagaacgggtattctgttacttaatttggacaaaccaggaagaaagaatgtattcagaagaaagatgatcagagccttgattaaaatggtgataatatagagaaagttaaataacattagtttatacaactaaaactgatgtagtaccaaatatatgacagggacaattacaagtaagacccaaaccatgaggattcaagtagaagagatttcagactgtatttccatgacaaagaagaaagtccttaaaaaattaaggaggtataaaaatattttcacataaacaatgagatcacatggacacaggaaggggaatatcacactctggggactgtggtggggtggggggaggggggagggatagcattgggagatatacctaatgctagatgacgagttagtggctgcagcgcaccagcatggcacatgtatacatatgtaactaacctgcacaatgtgcacatgtaccctaaaacttaaagtataataaaaaaaaatattttcagataaaaaaaaagaatttgttttgaggaatcctaaccttaaataattactgaaggaagttgtctgaacagaaaaaaaaaaaaaaataacagaaaaactctcgaacttcagaaaggaaggaacaccagaacggggaacaataaaatcagtataatagaccaggattcttattcatttcttaagtcatattttatggttgaaacaaaagttataaaactacctgaggtggtgcataatatgtgtaggaaaaatacctgacaattataagagccatatatgacaaacccccagctaacatcctactgaatgggcaaaaatgagaagcataccccttgaaaaccagcacaaatcaaggatagcctctcaccactcctattcaacatagtattggaagttctggccagggccatcaggcaagagaaagaaataaagagcatccaaataggaagagaggaagtcaaactatccctgtttgcagatgacatgatcctatatctagaaagcccccagtctcagcccaaaagcttcttaagctgataaacaacttcagcaaagtctcaggatacaaaataaatgtacaaaagtcaccaacatgactagacatcaaaaatagtcaagccaagagccacattaggaaagaactccccttcaaaattgccacagaaagaataaaacacctacgaatacagctaacaagggaagtgaaggatctctacgaagagaactacaaaccaccgctcagagaaatcagagatgacacaaacaggaaaaaactttccatgctcatgaatgggaagaatcaatatgcttaaaatggccatactgcccaaagcaatttagagcctcctgctctctactttttgcttaggattgtcttggctatttgggggttcttttctggttccatatgaattttaaaatagttttttctagttctgtaaagaatgtcattggtagttttataggaataccactgagtgtgtaaattgctttgggcagtatggccattttaacgatattgattcttcctatccatgaacatggaatgttgttctgtttgtttcatctctgatttccttcagaagtgttttgtaattatcgtcgtagagacatttcacatctctggttggttgtattcctagatattttattatttttgtggcaattgtgaaaagaactgcattcctgattttttttaatttaatttttaacttcaggggtacatgtgcaggtttgttacataggtaaacgtgtgtcatgggggtgtgttgtacagattatttcatcacccaggtaataagcctagtatccattagttatttttcctgatcctgtccctcttccttacctccaacttctgatatgccccagtgcctgttgttctcctctatgtgcccatgtgttctcatcacttagctcccacttataagtgagaacatgcagtatttgattttctgtttctgtgttagtttgctgagaataaagacctagagctctatccatgtccctgcaaaggacatgatcccattctgttttatggctgcatagtattccatggtgtataactaccagattttctttatccagtctatcattgccgggcatttaggttgattccatgtctttgctattgtgaacagtgctgcaatgaacatatgagtacatgtgtctttataatagaatgatttatattcttttgagtacatacccagtaatgggattactgggtcaaatggtatttctgactgtaggtctttgaggaattgccacactgtcttccacaatagttgaactaatttacactcccaccaacagtgtaaacgcctttctttttctctacaaccttgccagcatcagatagtttttgactttctaagaatagccattccgactggtgtgagatggtatctcatcgtggttttgatttacattcttctgatattagtgatgctgagcattttctcatatgcttgttggtcacatgtatagcttgttttgagaattttgtgttcatgtcgtttgcccatttttttaatgttgttttttttattgtaaatttgtttaagatctaaagggagattcttgagccacatataatattattcctagataacgataggcagtgttttttaaacattcatcttgagattaggtgaaaacacttattgtttcaaacttaagaaatgaccttagtgttggaaattcaaatttcagaaaatagaaataatggtgacctcaaagaaaggagcaaatttacctctagccataaacattctgcacttaacagttacctcacctagaagttcataaatataattcataaatgataaaaattgcttttgtcttcaaattattgataaaaattatagtcattataaacacagcatataatttcgactgagagggaatttgtttttgtgtatgtttttagcaatttacggtaactctaatctctatcatttctgttttaggtgctaaatgatcagataatcaaaatcatttttttttgcaacccacagccattagtttgtataagagggttaacgattgcatactggatcatttacctgcagacagtgtacaattagattcattgctgcaattagattcattgcagcaattagattcattgctgcctctctttgttcctttcctgcttcctgtattctaaagtgctaataattcgtgaaagataagagagtacaatatcacagggaaataagttaatgtataacatttgcattttgttccaaatgtccaaagtgataacctatacatggtctctgaaatttagcagcttcttacaaatgagacagttttaaatctctcttcacacataaataaattttcttcccttttttgtttttaaataatcacaaagataacacattaagagaataatctaaaacaggatgaccaaacctaaaaccaaatgtatgaaaaaaggtttacatgaaccatctcatttagttaaaatcaaaactaattcagataatcacctttaattttgccttctaaacatgctaagcatttgaattcataagatttctcaccagtgtaatattgtggaaattattccctattaaaagtgctgcttctgcgaagcagccaatttgttttacatatctgatgtgtatgacagatcagagatttgtttttcattttttaaagtcacagttgagatactcaactgcaatgattttgaggtagaaaacataaaataagcatttcctattgtatttttgcaaagacataggcacagggacagctcaagaactttcccacagtccagctacccacaagtggagatggacccacctggtcattgagtaacatattcctttgtctatgccaagaatctgctcttgaaacatagcaacacagggtgttaccaaaaatgagggaccaacatcttagatcgttctaccacaaaaagatagaatcagaggatattagaaaaagaagagactgacctttcagatcatttttttcaactccctctatttatggataaaaacatactacctatagaaaaaaaaaaaaaaggagagcccacaatagaaaagagttagtaatagtgtggagacaaaacctctgattgtcattccagtgcacttgaccctttggtaactcctgaaggtcacaatcccttaaagagtgctggctccaggtttctacactgtcttactgcatatgttttgaaatagtttctgtgtaaataaactttcctcaccttgtgcaattttgagtgtgctgtctgttttctattatgatatgatggatacactaactcctagtcatcttacaaacattctgagcttcagtttttcatctgtaaaagagaggtataatgtagatctcacacagtcgaaatgaaaatcaaatgagataatgtatataaatcacttatcaaagtacctgacacacagtaaactcccaattaatgctaattatcactagtgggtatactatgtcttactcttctctataaatagagatgtgtagaaaattttaatatttcacatgtttaagggaaaaatgttgtaggaatatcagtagctacttgagaaaattattctattatgtatttaccaattctaattaattaaagatacacggtctaattttaatttatcttcttattccacactgaaacctccccaaatggaaactgtgaatattttaatatctcataattttaccattttctatctggtattataagacaatgacttaggataagaatccatctatcacattaaaaatactttgggaaagaataaagtttcttaggtaacaaaaggggcatcataaaagttttcaaaaattgtttatcttccagataataaatatcaacatgaccatttatcactgtatcaccgatatatacagggggaatcaaaatatattttttcttttttcttaattttatttcaatagctttggaggaacagatggcatttggttgcatggaaaagttctttattggtgatttctgagattttggtgcactcatcacccgagcagcgtacactgtacccaatgtgtagtcttttatccctcacccttctcccacccttccgccaagtcaccaaagtctattatatcactctgatgcctttgcgttctcatagcttagctcccacttaaaattgaaaatatacgatgtttggtttttcattcctgagctacttcactttcaataatagtctccaactccacccagattgctgcaaatgacactatttcattcctttttacggctgagtagtattccagcgtatgtatacacattttctttatctactcattggttgatgggcatttaggctagttccatattcttgcaattgtgaattgtcctgctataaacatgcatgtgcaagtgtctttttcatataattacttcttttcctctggatagacacccagtagtgggattgctggatcaaacggtagttctacttttagttccgtaaggaattgccatactgttttccatagtggttgtattagtttacaacgccaccagcagtgtaaaagtattcccttttcaccaccatctgttatttttttattttttaattatgaccattcttgcaggagtaaggtcgtatctcattgtagttttgatttgcatttccctgataactggtggtgttgagcactgtttcatatgtttgttggccacttgtatatcttcttttgagaattgtctattcatattcttagcccactttttgatgagattttttttcttgctgatttgagttcctcacatattctagatattagtcctttttcagatgcatagtttgtgaacattttctcccactctgtgggttgtctgtttactctgctgattatttcttttgctgtgcagaagctttttagtttaattaggtcccatctatttatttttgtttttgttgtattggcttttgggttcttggtcatgaacttccagaagctgtgattttttaaaatttatggtatctatttctgtggagcatttttcatccatatcctgtattgtcctttttaatgtttttaaattggttttcaccttgctctggtatctccttgtgtagcttaataatcagcctcctgaatttcagagatttcttcttggtttaaatacattgcttgggggactagtgtggtcttttggggatgttataggaccttgttttatcatattacaaggattacttttctgattccttctcatttggattaactatttcagtggaaaaatctggaactccagggctgctgtttagattcttttgtcccacagcgtgatcccttgatgtggtgtactccccattcccctatggatgggacttcctgtgagcccgtctgcagtgattgttgttgctcttctgggtctagccactcactgtgcctaccaggctctctgctagtgctggggaatgtctgcaaagagtcctgtaatgtgatggatcttcaggtctcccagccatgcatacaagtacctgctctggtggagatggcagcagagtgaagctgactctgtgataatccttggttgtagataatgtttagtgtgctggctttcccgaatgctggttatgctagcagtaaagttgtcacatggacagactcaggaccacgggttagcctgaatgttgcaggcagtagaattagtttttgttttctccttccttggagcagggttgttctgtcatgtgttgctgtaatgttttgggttggttggcctccacccaggaggtggtgcattcacaagagcaccagctgcgatattaaaaggggaatataagcttaaaatatcttaaataaatgccaaataaatgttcttttgcactgtttagaggtttaatgtagactatgtatatttctacaaaatctagttctcttatgagaattcgatatccatttaagggagctcttttctttcgatgaaggttgatatgaatttaggagacttggtttacattttcttcaacctgaaactttaaatgatgattgagaatgtgtaaagttgtcccatatttttaaaataaactttccaaattggaaagaaatttaggtccgaaaagagcgtaatggttcctttagagtggaccacagatagaatacaagttggaatcaacttgcagttagatgagagtgtcataaaaataatatgattgaattaatttagcttatatcagcatctctggccaaccctgcttacagggtgcccagggctgaaataagaagtgtttctgccatttatttgctggggttttggcagacattcatggcagtgctcatgcggaccttaaagagtacattatttttatttcccttctcattttcttaagcagtagtttttgctttatgactaattaggagataataattaggttcagaatttttttcttcatttttaatatactttgaaccttgcataggccccataaactagttgtatacatttaactttcagttttaattccttagtcttaagaaaaatagcaatggactttaaaatatactttatttttcagagtacatttaggttcacagcaaaaacgagcagaaggtacggaaatttctatacacccactgcccccatacaggtataacctcccccattatcaacacgccccaccagagtggtacattctttacaataatgagcctacattgacacatcattatcatccaatgttcatagtttgcagtaaggttcactgttggtgttgtacattctatgggtttgaatgaatgtataatgacatatatctatcactatacattcattaatcatacagagtatttttactgttctaaaaattctgtgatcagcctattcatccctctctctgtgccccaataataaggtttaaatctaagaaaatatgtacagccccaggcaaccactgatctttttactgctgccatatgcttgccttttctagaatgccataggtttgccttttctagaattacagttggaatcatacagtatgtaggctattcagattcacttctttccctcagtaatatgcatttaaggttcctgcatgtcttttcccagcttgatagctcattctttttagcactgaataatattctattgtctggatgtactatagcttattttcccttcacctactggaggatcttttggttgctttcaagttttagcaagtatgaataaagctgctctatacatctgtatgcaggttttgtgtagacataagttttcaacacctttgggtaagtaccaaatagtgtgatttctatgtttcatggtaagtgtgtgtttgtcttgtgaaagactgccaacctttcttccaaagtggctggctgattttacattgccactaacaatgaatgagagtttccattgctctacaccctggccagcatttgttgttgtcagtgttctgaactttgttcattctaataggtgcgtaatagtatctcactgtcattttaatttgcatttcaccgatgacatgtgacatagggcatcttttcacatgcttaattgccatctgcaagtcttctttggttagatgtctgttaaagccttcagctcatttttttgtactagggttgtttatgttatataaaatttttagttattttgaatacataatagttgtacatatttatggggtacatgtgatattttgatataaatatacaatgtaatcaaatcacagtaattggggagtccatcaccataagcatttatcacttttttgtgttatgaacattttaattctactcttttagttattttgaaacatgccataagttattgttaactatcactctcactaaaaatcaagggaaattttcctctggaaatccaaattaatgtcaaggcctttaagaccccaaggaaaatttaatttaacttataaagaagatatcaaaaatatctcaagaaatttttgggacaaagctagacgagttcagggctaaacaagatataatcaaaatgtaaaaagcaatgcttgaagtttctatgacaatttgttaacctcgagttgtagaaactccctttatccttgctgaatatgattttatcatctaaaggattaaatggtttttttgtgtggagatgttgggtaagaaaaatgagacagatacatttgccatatggctgtaggtagcaagatattttagaacacatcagacaaatatatgctcatccatgcttcacggtacaagcatataccgtggattaaataactatggtctccaggttcagttcctttattattatcatattctacaaacctactttaagggatattgtattgatttaatcatcatttatgtacttattaaaatatttcttgtttcttacgtggtaagcactactataggtactacggatttagtagttgaaaaccatggtctcaagcttttaaagcttacagtctatggaagatagacccaccaatacatattaaataatgtgtgatgactattattaaaagagaaatgtagaagatatgatgacatatagctgaaggaagcctcactggagaaatacataatattaggtgatacatataagaaaaacttgcaaagaaccagtcattttactatgtatgaagagtaaagttgtttggtaaacatattaaaacagttaagacagaagtagcaaagttagtaaatgcatgtatgtttggggacctctaaaaagttaagaaggtcttaggctaagatgaggttggaaaagtagcttgggaaatatgtttaatgatacaaattccaagctaatgattatggacttcaatctacatgccctgttaatattatggctatgccagggagaacttaaaatcataggacagagaatatggcacatcttcatcttcccagaacatgaattttactggaagatatgtaaaaattagcagaagacacattgtggaataggagcatgatactgatgtgacttgtaaaggaaaaataaattaggctgataaattttcaattgttggtagcaatgttataattcaaatttattcagcacaataattacagaactgaagggatagatatttggtcatttactggcatggagccattgacaagtttagctaagcaatgtcatgctcatggtacctagcaaggcttcagttgatgggcataaactgagtatagcaatttatcttgagaacatttttaatttgttaaatatttattttgtaactaagaaattatttggtgtgagatggtatctcactgtggttttgatttgcattttctgatggccagtgatgatgagcattttttcatgtgtctgttggctgcataaatgtcttcttttgagaagtgtcagaacggcaatcattaaaaagtcaggaaacgacagatgctggagaggatgtggagaaataggaacacttttacattgttggtgggactgtgaactagttcaaccattgtggaagacagtgtggcgattcctcaaggatctagaactagaaataccatttgacccagcaatcccattactgggtatatacccaaaggattataaatcatgctgctataaagacacatgcacacgtatgtttattgtggcactactcacaatagcaaagacttggaaccaatccaaatgtccatcaatgatagactggattaagaaaatgtggcacatatacaccatggaatactatgtagccataaaaaggatgcgttcatgtcctttgtagggacatggatgaaactggaaaccatcattctgagcaaactattgcaaggacagaaaaacaaacaccgcatgttctcactcataggtgggaattgaacaatgagtacatttggacacagggtagggaacatcacacaccagggcctgtcatggggtggggggaggggggagggatagcattaggagatatacctaatgtaaatgacgagttaatgggtgcagcacaccaacatggcacatgtatacatatgtaagaaacctgcatgttgtgcacatataccctagaacttaaagtataataataaaaaaatcccaacaattaaaaaaaaagaaattagttgattttagtctcactctatgtatatataagatttccttaggaaaacgacatataaaaaagataaatctatattttagcggtggcattttgcaggcttttttgcactcagatatcttccagggaataataggccaagtcaactgttcatgattacattcctagagagggactctggatcctcgggtttgaatgaaaagatactgggctacctagtaaaagatgtttatattaactctaaggcggcaatagataaatgatagatatattaggtagacaaagttcaaataaatacatttgaaaatcaaaataataaaataaaatctcttcggaaagtttcagatacaattcctaaatttaccttaacttaaagcattgcttgactgaaagtaatatggaatttttagtttggtgagtctaatgcatgcaggtgccttctgaattgtctgcttttctcaagcatctaggagatgataagcaggaggtcgggattaacctgtgacagccaacctctccagatctctaggtaatgccaggtaatccaggagtgcatctttcagcttgctccactagaattcaaaatgccacataagcgtccaaggggtagatacagcttgccttcagaggacattgagatggaaacatcttggtcagtaccccataaagagtctagacgtacattcgagtccagatttgttttgattgttgtagtattatctttcattattttattgttttcttataaaattaaaagataccaaagttaaagaaaataagatttcctgattaaaataagtacttgtcaaactaataataaatataattaatatatttaactaaatatttgaattttgtgagaaatgttaattattttgctggcatttcatgggaatgttggttttacgaaatagagttgtgtttgaaattacaaaggagtatttatgtttgtgtgattgttaattttaggtgtcaactttcctggattaaggaatacctgaagagctaataaagcattatttttgggtgtgtcagtgagggtgtttccagaggagaatggcatgtgagttggtgaactgagtggggaagatacacccttagagtggtcaggcactatccaactgctgggagcacagataaaacaaaaaagcagaaaaaaagagaatttgttttttctctctgctggaaccaggacacccttcttcccctgcacttgaacatcagaacttcaggccctctggccttttcattccaagacttgcaccagcagccccctcgctcacaggccttcaatattggactgagatttacattacttgcttctttggttctgaggttttcaaatttggactgagccatgctaccagcttagctgggtctctagcttttagatagcctgttgtgggatgtctcagcctccatgattacgtgagccaactcccctaacaaatcttctttcatctatctatctatctatctatctgtctgtctgtctgtctgtctgtctgtctgtctgtctgtctttctgtctgtctgtctatctatttatctatcatctattatgtattcacctatcctattggagaactctgactaatacagtttgtaataaaacaaattttgctaattgtgtgtacttacttatcctcctaatctataagacagaaaaattctaaaaaacagcactactatttcactgcattattcaaaccattgcttctttggaatttgacaaatgaatcatgacatagatttatacacaaaagctcacaaaatatgcactttagaatcacaaaaaacttctcatccacagtccatttacataaaaatagatatcatagctatctctccttttcactcttcctactttttcaatttccgctactcttctaccacttttactaacattttccccaatacaaagggaaattgttttcttcaagattttagaacaagaatgattaatttgccttttagccattgttttacattttcatgaattttgactttatatagtttttatcattgcctgattacatactcaagtaagtatacatttgaagatgacaactatatataactacatttaagtgtttaaaaatggtatctacatggctttgtcaatattgttgaaatgaactgaagatttttaagcaagcatagtttggattccacctgaaagaaacagtacattgatggttcccaagctctagtcataccgcaagtgaccatctaggatagtttcatatgcctgtgaattgatgcagaaatttacctgcagatcaaaagtgccacaggatataaacattgtgtgatgatcgcattctagccaaggttaaaaagaatatgtggtgctttgaaaattttgagatttttatgttttaaaagctagatatttatacaattatgatatttaaaaatatttaaatatgttattaaaactcattaaagatatttttccaatgaaagcaacatattttcaaccaggataaatttggtttgtattagtggatattgaggaacaaaaagaagagattagataaacagtgcttcagtcatgttccatgaagaattgtacctataacttctttagtgagtcaagagaagctagttcacaggtacattaatattttctccatgtctgccacattaggctcttaaagttctttcctgtttctatacttgctctcctaataccttcattatagaacatagcacactaaaagtattgatttacgtgacggtcatcccttctaggtcagtaatactcaaaaatagctggaaagcttgttaaacatggggattcttaaagcctcacttccagagtctgatataataggtttagggtatgcacagaaatctgtgattttaatcagcaccccaagttatttgtcatagattatcctcggactaccatttgaaaccaaaatctagtctatagggcaggatcatgtcatagtaatttttattttaaatcaggtgatgaataaatgttgaattttaagcaaagttcaaagttcaattgtagacatttcaattcaaatataagaagtggcccatgataaagtaatatctagcttcataatgttgaacaccgtcctttatcacccgtgtttctcaactgagagcaattccttccccccatgaaacatatctggcaatgtctggagaaatttttggttgtcataagtgaagagcgagtttgttactggtatctgtccagttgacgccacagatgctgctaaacatcttacaaagcatggaatggccccagcaacctagagctatgcagctcaaaatgttactagtcccaagtttaagaaactctgctttgtcatgatcccaccttacatccctgatccccctttgtttgggacagagtcccactctgtcacccaggctggagtactgtggtacgatctcggctcactgcaacttccacctcctgggttcaagcgattctcctgcctcagcctcctgagtagctgggaatacaggtgcctgccaccacacccagctaatttttgtatttttagtagagacagggtttcaccatgttggctaggctggtctcgaactcctgacctcaagtaatccatctgccttggcctcccaaagtgctgtgattacaggcataagccactgcacccggccttcctgatcccattaagaacttctcccccatttttccaatggacatcctatatgcacatccatgggatggaacatattctgcagatagtcaagtatttttccctagatattttttactttgctctacacatatgctttctctatctactgaactaataatgttactcactagatcaaacttggcctctgaattacaaaagtcttttgaaacatatggcagagaaaatcttgaaaaccagttatattactttcaagagtcaggtattttgcaacacaaaaagctaagcctggacagaaacttggcaaaaaaatgtgtgcactaaatgatagatttgaaacagataaaaaagattcaaaccaccctatctttatagattagataaagattgcgggagctgaaaaaatagctcctgagaggggggctggcatcattccatcccagaatgatgaaaacaccaggcaggtctggggcaatctgagagcagaggcgaattgtgattcattctctgggcaaagtccaaagaagaagcaggtttcacggtgaatttctttattactgcatggaattacatttgtgaagcataaatgatgcgaaggcacatgtaaagaaagagcactttagagcaaagagcatctacagccacagaaagtattcctaaatttcctatgccatttaagagaagtgcaggtatgtctaagagaggggcagatatattttccctaccgacaacgtaatattatggtaaggtctccaccattttccgtctttcttattactaatcacctccataacctgtggtcaactctgaggataagggaggaagaaaaatttcccaaatgactgaatcaataccttaaatgtctaaggaggaaaaaaccccaccgaccaaacaaaactatactatcataatttatctggaagtgactaaattttatgccatgtagaaggatgtgagcttcaactagagattattattctatagaagtttacattttagaataactattttgttgctttagtatattttcccatatatagatagagacttgtagatacacagtagttgtttcaatcttcgttttgctcatccaattgcctgagctatatctctttataaaaattttctcacttctgtcttgaccctatcaaaactcctgctgacctccacttgggagcattcactgtgaagtgtatgcaataatatgatgaaagtaattcacatcaacttatgataatctgaagtgaaaaagggaatagtggatttcagagcagtgagtctatatacttgcatattttggatgttcaaattgaaatatatgtaactagttatgccgtttatagtgtctttcacttgccatgccaactcttacattcaaagggtataaaagtagactcatgctttcttcaactttgcaaatgatcctcactttacactaaacaaagagtttttgctcatcaaatttgaattaggatcatgtgtactcaatatgtataacatactaggatacatcaaatacacgggtattctcccagactacaaaaaatatgtctactatcttaaaatcattccccatgtacagatgggtgatatatgaatatcagaggtgtgttcttatctgtaaaaaaggaataataataataatacctgccttaaatagacatgcttttgaggattaaatgagataaagttagaaaactttcctcaaaaatgttggttctttccccaggaacatgtctctttcaggctcagagatgtcaaatatattgacatttttaatataactggacaaataaataggactaactacaagaattaacagtcgtacaatgtcaacatatagtgagaaactagctatggaccatgacttatgtgatttggatgaagtaaactactatgtaataagagggagactgctaaaacatttctaagaaaagcaaatgagaacaaaatcaagtataattagaagttctgaagaaaaataagaggacatagctaaacacgtttttggacttcaaaatacgttcttatattgctttttctcctacaaaagatagatgctattatagtactggacttataatagataagagactagttcttgtttgattttgtgaagcactgtgagattaacctggctcctttctgcccattccaagcctaaagtcctgagggtggtgggctgtcactttggcatctcattccaaaatttgtacagaattcagccaggcaatggatggatgaagtgattataaaagtgaaggtatttcaggaagaaacataactgcattcataagttgttcctccattatctccattgcctttcacaatctcagatgttgggaaaacattaaaatgcacaaacatcacagtgtatgggcaaaatcatgaatgtagaagtaaatattcaagctcaagtattttgtagctctgtgatcttagtaagctattttgccactctgtcaatttcctaaaggctaaaatgtgagcaataatatttcaaatggttttgttgtgaaaataaatacagcctttaacttagtatcagcatagaataaatgattgtttttttcaatgagtgtgttgaaaaaatgaattatattaactaaaatttgcttggtgtttggcatataataggactcaataaatgttaatgacataaatcgataaatgaatgaaccaatgaataaaataagcaaacccagagaaaagtctctaataatatgtcatgaagttctatctttggccatttcttgttcttgccttcattgcttatatagaagagaagccattctcagaccagggatttccatatatcttctttataacattatctgtggctttatcgtgctgatgtttactaagccaaagcacatcttagactctttggtcaccactgtttcataatctagttcaactgatgttccaaaatattttactgagaacattttactcttctatgtattccttaaaaatgaaactgactgctattaaaattaagaaaacgtcctaattaaaattatggcttttttcaaggtttccaggttttattacctttacaactttacttgaggtttacaagtgttccatacaattaactcttgtttcatatataataaaaggctaggcattttattataaatattagagatgcacatacagttgacacactcgtctcctaatatcaattttaaggcatgtcttagtgctttattatgtatatgaaatttgccacttggaaaacatatgtatcatacttgggatttctgtacctaaggagataattttttcaagctattgtgagataaatatgcccatgggaagactgtagaacaggagacgttctctcatgatcattctatagcatatatgaaggtaaagagaatacctcttaacctacttatcataataagcattgcattgttacaaaaaaactgttgcattaataaaaaatttcctaaagtacatatatcattttaaaagtagctccaatattaaatcagcaattaccttcacattggaactcttttctgtgttgtgcctgaggcagcttccagaagtcatacagaggtaacagctgccacaaaaaactgaggacttagggaagcccacagtaccagaaattccatcttttagatggatgccaagtcagactagggaatatgacttaaaccttgatgatcagagaggaatgtctgtctctgtgtgtgtatgtgtgtgcatgtacatacacgtgcacacatacacccacacacactttgcaagtcagatagcattcgattgacaattactgtcacatttaactttgctatgcccctttgaatatgcacttagataaaaaacttttctcagtatcttaaattaatgtatggagccatggagtcctattcttatagctagagttggcgctgtgtaaaatggctattacgagacatctcttgttcacaggatgacctggtttttcaatttagaaaatcatctcgtatgttaaggaactaaaatgacatggtcagtaaagcacagacatggatggtacggatctagttagcgggctgacatattgcatcatgaactattcatacatgaagttttccattattttaaagggcagcctgattgaaattgagattcactatgttaattcttaaacatacatagtgtttagatcaggaagtaactttggtggttatcctcagtacatcctttcttcctgtgcatattcatccttttgttacgggagcaaagcaattggttctcttttatttatttattttatttctcgagacagggtctcgctctgtcacctaggctggggtgtagtggcccaatctcagctcactgcatcctcaacctcctgggttcaggagatcctcctgcctcagcctctcatgtagctgagaccgcagatgcacgtcaccgcaccaggctaatttttaaaaaattttttgtagagatggagtctcgctgtgctgcccaggctggtctagaacttctgagctcaaaagatccttccccatcagcctcccaaagtgttggaattacaggtgtgagccactgtgtctggtctgttatcttctattttctaaaattcattggaataagtcatatcccaaattaagatttaacagcctataaacatttctttacaagtgctttttttcccgaaagactatcaaaataagaacaatatttttctaaagttgatatttagaaatcttttccaaaaactatgtaataatgtgcacttcataggattgtaatctattaacctgataacagtgcttgacacacaataggtagtaaatacttggtatttgtcattgttcgttgtggacactacttaaaaatctctcattgtacacataaaatagaaaataaataagtttaatggcttattcctggtaatgataaataaataataaaatttattttacatttatttatttatttgtttattttgctatctgactagcaaagcatgtgtggatgtatgtgtgcatgtgtatgtacatgcacacatgtatacacacagagacagacattcctctctgataaatataataaataaaataaataacaaataaataaaaaaagtcaagaccagaagcaaaatatcctggctgtcagtctggtgctccttcccaaattcagtacctcttctctaagacacatttagaaacaagaatatcgaatgataaataatcaataaaacctagttattgaaattatatcattatggaagtaactagtatgtttcatacaatcagaaaccattaaaggtcgacaaagttataataaaccatatgttagacagttatagctacaagtaataatatacacaacttgtcactagcagacaccaaaatttgaaagtgacctccatcagtggacactgagaaagtgaagaatctggcagttcaaatagggccacattcttatttgtgggtctttattttcctccaaaagactccatgtcctcctcccctaaattcatttaggtcaattgtgtcaccccacatcacagtgtccaattttcatggatgtgtaaaaattaactggactgaagaaaatgcagaaagaaagagaaacagacaagttatgcttcccaattattgtattcggtggtcctacagatgtcataaacagattatctcaacaactaaaataaaaatgctttacttctactattctattctctctaccagaaaacattctgttatattcatgacacctttaaatataaattatctaagagctataagatatccatatattcattctcagaacaaaacaaaaaagtgtgaaaataccaaggaaacaaaagtggatagttttgagaatttatctccaaaatattcatttggcaattccagaagtattctatcactccctcctcagtcactaatcctaccaccacccagattcatctgggaagaaataccatattagtattatctgcactaggtaattatctgcactacatcaattatattatggctacacagcattttgtgagatgacccaggaacttaactgccataagttccaaacaactgattcacagttggaagctgcatacattttggctcaagaaagaatccctcatggagatgtgagagagagaaatatgagtgccaggcctaccacgtcagccaaattggcctcagcaatcactggggcagcacatgttgtatccagagtgtctccataactatattgttttcctttaattatgagcatacaaaattcaggcactgggataatgagaaacagcagaaaaataagggcctataacatagagtcatgtgcaccgaaatgatgtcacaaatagatgcagcaccatcgtgaagtaatgtcacaacatagctaaatagcacaaagataatttaagcacagatcttctggaaagtacacaaatatggataacacatataatagtgtcctacactaggtataacagagttattttggtaagacaatgagaacgattaaaaaaaaacatgcccaaacatatggattcttcacagaggtaagctcacattttagcttctatatttgtgtcatttatcacagatcttaagatggctcctgtccaaggcattgtgtatttagagtcaataactgttaagctatctcagaaaaacatacaggcttttattataacctgaaattcacaagaaaatgctaggatttaaaacatgtatttctaatattgtaggttagaaatctgaatttgggggtttctctcatcatatatggactaccagggctataaggagctatagttttagtgtgggtaaccctgtcatttttgtcctgggcaactcttgaaaaaagttatgccaaaatcacagtttttttggatgaaacatttacaactggaaaaagatcaaagtcaacaccttgaatagagcccagaatctgattggtaactgatctggatataattcacggatgttacacgctctatgcttttggctcttccatctgctctgcatcattcttattttgaatagctagcacttcagtcagttcatgctaatctaatattccaaactggacactgggatcataggaccaaattatctgccttaaatgaaaaagacgaatatatccaaagaatacacgactacatggctatatgtgcatatcactggggaagaaattgtcttggatttttaattttttttaacagttgaataatttaagacatcatatatgtaacattttcaatcatggtatcacagagtcttgcattagcatatagtttacagaaatctagtctatacttacctaacagtaatttacactaactgtgtctgaacacagggctaattccaaaaattaaacaacatcatgtttctagacataaaagtaagtaagatattattactgacttttaggggactggaggcaaatgtgggataaaaaggtggaaaacgatagcacatatattagtgcttatatcatatatgcaaaataaaaggtaattgctaatgtagattgtcaacaagtcatggtggttcaaaggaaaataaagaacattatatcaggctggggaaggtgaggtaaagatagatttcatgtaagaggttgtacttaacagggtcttgaatgagggctgataatgttaaagacgtgataatcatttataagaaagaaccttgaaagtgacaatctaccttaaggatataacacaaacatatataccaatatgaaaatgttagcctacagtgcattagagatctgtgggcatagttcatttcaaatagaacagaaagaaaatatcagggagagtatggggcataaagacagaagctcagtttgacgtcatgcacaaaacatcaaagcaagaaaattttacataaaactataagcaatggggagtcattaaatttatggaatggaaagtcaacactattagaactgctcttaagaaagagatttatttccagaaaatataatttacaggaatattacatagataattatctagtgactatgtaagaggctttgaaagattttaggacgtaatgcaggttgatgacattggtaatgtttaggaagggagaagagagagaaatattaagtcagactctatggactttggcaattgaattggaggctaaaaacagaagtggagagggattatgatatgaagggacccatgggtcaccatctctggtcttggcccaccattgtgtactaagagttacttcttcttataacaataatggttacttttgttatatatctcaaataattctgaactagatgaagttcttgtaagaaaaaaaaggagggaggaaagatatactcttcttctccctctgcccccaggcccccgctatcccctacagattgccaggccattggagagacatagataatgaaaaattaccagggaacaaaaaattaaaaaaagacatattgatatgatacaatattcaagtaattattgaatgcaaaagaagtcacaacaaaaatgcttaaaatatgattaaaagagattagaacatttatatttctggtaatatgatgtgcacatatcagtgtgaataaaaaatgctgaatggaattgtgtaaactgaattatcaccaagtgagttacgctaaaatattcatagttttctttttgatccttatgaaaattacatgactttgatggtagagcaaatatataaccattagatgtcatatatttacatatactactcaaatactcttcaattagtcctaaaaattgcacctacatggctctttatatttccctaatgctatgtttatgggtgaaagaataactgtgcttttaccagaactagggtaatgaatatgagcttatttagcaaaagatggtaagttcagtttgggctagagtttgatgaactacttggatagtctagagaaaataaccactagaaaatatggggctgaagttgtgaaagacatcaaaatcagagatttaaattgttttttttttagagacgaggggattaaattactattgaagagtggagaaaaaaggtggtcaagttcggatatcagaacatttgcttgagaagatatatcagagtaaaagctcttggatatagaaagaaaattataatctgagtctataattgttatgaagtatgcctgtattttccttatggaatttgatgtcaaaaacacaatttcaagtatcttctgatgggtatgccacaatatggtctggctatttggagaacactctttgataccagcagtgatcgagaggaacgcatgcaaaagaggacatgttctgactgaagagttacagggtactttgcaggcatctttctggctctagaactgaattattttcacacaaaagaaacaaacctcagtctggcaattaatgtgctatctgtgttagtagttcactgttaatagtctaatgagcagaatatcagtttggaataccactttatttaaaatctacaagccacacataagacatatataataattagggatcctaaaatgaaagtcaaatattctcaaccatgcatgtgtgtgcgtgtatgtgtttgtatgcatatttagacattttgtaaatcaccaaagatttaatttagatagaggaaggttggaggtaaggtgcatatggggaaattgactaagaggatcttcacatgagcaaagaatccaggagggcctggtagcaagaaaaataaagcaatttgcagacaaaagaattgtctgtactacaaggaagagaaggcaggaaaaggaacattttctatccatccattcacttattcattcaatatatacttattgaatacatcttaagtgtcaaagactgttttagcagtagggttatagcagtaaacaacacaaatttcatattctcaagaagcatgcatttggggatggggatccattttacaaatgaaacgttaaagccaaatataaagttctatgttagataggatggtcagagaaagcccgtatggggagtgatgtagacaaagtgagagaggaatccatacaaactttttgtcagtaaaagggtgatcatcctagacaaaggaaaacattgactgcaaaagccctaagtcaggaacatgcttggcagagtcagtcaagaaaaatcaagaaagctaataaacttggaacagggcaaatcatagggaaaaggatgggaaatgagatagaacagggatccaaaggccagataagataaatcttacaggcaaaagttaagaactagaattttgttgtaaggctggcatgaagcaattagacagacataatctgccatatgttttacaagaaactctccggctgcattgtgaataacagactgaaggcggatataattgggagtagtaaaacaagttaggatgctactgtagttgtctaagtgagaataattgaggattggactagatgagacaattagtgagatgcctctgaagactggttctcaaagtgcaacctggaccagcagcatcaacaacccttggaaactggtgacatgtacagattatcagatcctgccccacctactgcatcagagactctgggaatgagacccagcaatctgagtattaacaaacccagtaggtgattccaatgcctgctaaagtttgagaactgctgctttacaagtaaaggctcccctaattctgatttgggttctgaatcattcgagcacttttgtgtcactcagtaaattaaatgtacatgtgtatgtatgcatgtagtataagaaatattggccttaaaacgtaggaaattatttaatgaggacatttggagcaatgtgaagtagaaaaaaattaaatatggggtgtataacccatgtgcacattgtctcagtacctaaaaactgaatttcttgctctaaatgcaggccacattctgattcatttataatacggtatcatgctactttagaacaagctttaatttaaattgccagcactctttcatgcaaaaaatatagttgaatttaatgatctcattataagtgataaacaattactctgcagattttcaggcaagccatattttcattttttaaaaagtcacttgtgttaccagtgatgggcatctacattaacaaaaactgtaaaccacaaatctacatgagttgtatataattaatgagtaccacagtctaaaatatagaaatgagaggtgactaaaaccctgaatattttgagttgctgttttgagcagaaagcataataggtcataacagaggcttcaaaatcaagaagattctagaaggttaattaccaaaaataaacccactggggaaagcctctctgacttgatggtctgcatttccccttgtgattacatttaacatatatttcagggtccctttgctggaagaaaaaaagtgaagaaacaattaaaaacgtttagtattaacacaataaaagttattttaaatacatatatgtatgtttgtttacctatgcatctatctgcattaaaaatgactgtacatttatatactcctcactgaaaatacattgtgtctcaattaccactctgatgaataggagatagatttagaatattgctgtacatcccattgtgtttacactggggattttggcaacctcataggacccccaggaacagataggctggttttgcattagagctatctgccagaagatagtgttcaaagggtacgacgggctctcttgatcactgtggtaatgtatattcacagtatattcagaagacagggaaatacacttgacgccatatatgtttttgttcatacatataatttaatttttccaagaaagggccaaaagatagacaaaatacaattgatgtgtgatttctgcagcttgatcttcctttctggtattattgtcttttgctgtctttcactgttacgatttaccattttctcactgagattttacaagcatctcctatattatcggttttcagacatggtttcaatacacacccttaacaaactggagcatccagagtaggaaggagagaactggcactagaagttgtgcttaagttgcctgtgaccactagtaagtgaccataaaaatgtgggctccccatagcatatccacttctgacactatattccagcagaaaaaacaaatgtcaaagaacctctaggacccaaatgtttcaccactttccttatcttccagatgtgatcacatcttaccatgactttgaattgattttctaaaagaactttgaacattccctgtaatgtatcaaactaaacataaacagtctgcactggaattgtacaggttacataactttatctcaaaatttatatgttagggatatattaatattgctatttatcccttattctctactcaactctactaatgaatattcactgaatgtattcagagctcctttcttcctccgtttctctactcatgagtctcatgtattaataatttgcattgtaaatatacgtgtacaaatccttgtgctcaatatttaaagaaatttgaaaagagggaaagaacattaactaaaacttgccatgaatcatatgaggatggtattataaaaacactgttaaaatatttaaattttttttcataaatgaagaaacagatttagggaatatttcattgcactaggttacttgtctatggtcatccaactagaaagtagtggaatccagatttaatcttagatctgatactgaagcctctaggttcttcctcttttccatgttgcttatcctatccctttcaaatagtgcacattatagactgtaaagtctcaagagcagcaatcatctctattgatttttggcctatccatccacttagcacataatatatacacaattattcaccaaaatttaactatatataaaatcaactgctaaaggaatctagtatcttacataatacatctagtaggtgaataacaataatataaaaaagtacacattaaatgccaaccattacattaaaagaacaaaaaagaaagattgaaattaattctgtctcacagaacaggtcagacaggtaggagacactgttgatgtcccatttagataggcttttaacagctctgtgaatctctgccccagtttcttcacactttactgctaaaagctgactcctgggacattgtgaagattattcttgagcactagagggggcaatcaagaagtaaccccccagaaatacaaaaaacctcatagactattatgaatacctctatgcatacacactagaaaactgaaaaaaaaattgataaatgcttggaaacatataacttcccaagattgaacaaggaagagactgaatccttgaacagaccagtaatgagtcccaaaattgaattagtagtaaaaagcctactaatccaaaagagcccaagaccagatgaattcacagccaaattctaccagatgtataacaaagagctggtcccattcctactgaaactatttttttttttttttctgagatggagtctgtctctgtcgcccaggctggagtgcagtggcaccatctcggctcactgcaagctctgcctcccgggttcatgccattctctgacctcagcctcccgagtagctgggactacaggcacctgccaccacacctggctaattttttgtatgtttagtagagaagggggttcactgtgttagccaagatggtctcgatctcctgacctcatgatccgcccgcctctgggattacaggcgtgagccacagcgcccagcccctattgaaactattctaaaaaactgaggaggagggactccttcctaagtcattctacgaggctaacatcatcctgataccagaaactggcagagatacaacaacaaaaaaaagaagactccaagacaatatcctcggtgaacatcaatgcaaaaatcctcaacaaaatactggcaaaccgaatccaggagcacgtctaaaagctaatccaccatgatgaaggaggcgttacacctgggatgcaaggttggttcaacatacacaaataaataaatttgattcaccacataaacagaactaaaaaaaacacacataatcacctcaataaatgcaaaaaaggcttttgataaaattcacatccatgttaaaaatcttcaccaaactagggattgaaggaacatacttcaaaatagtaagagccacagccaacatcctattgaatgggcaaaagctgtaaatattcctcttgaaaactggcacaagacaaagatgccctctctcaccactcctactcaacatagtactggaaatcttagccagagtaatcaggcaagagaaagaagtaaaagacatccaaataggaggagagcaagtcaaattattcctatttgcagatgacatgattctatatctacaaaaccccatagtctctgtccagaagcttcttgttttgatacacaacttcagagaagtttcagtatacaaaatcaatgtataaaaatcagtagtattcccatacatcaacaacatccaagctgagaaccaaatcaaaaattccaccccatctacaatagccacaacaagaataaaatacctaggaatacagctaatcatgaaggtgaaagacttcttcaatgagaattacaaaacattgctcaaaaagaaatcagagatggcacaaacaaattaaaaatcatgcttatagaatcaatatcaataaaatggcaatactggccaaagcaatttacagattcaatactattcctatcaaataccaatggcattctttaaataattagaaaaaaactgttttacaattaatatggaactaaaaagagcctgaatagccaagaaaatcctaatcaaaaacaagaaagctggaggcattacattacctgacttcaaaatatactataagggtatagtacccaaaacagcatggcactggtaaagaaacagacacatagacaaatgggacagaatacagaacctagaaataaggtcacacacctacaatcatctggtctttgacaaacctgacaaaaacaagcagtggggaaagggcttcctattcaataaatagtgctgggataactggctagccataggcagaagactgaaactagacccttacttacaacatatacaaaaatgaactcaaggtggactaaagacttaaatctaaaatcaaaaactataaaaactctggaagataacctagtaaatactattctgaacatagaacctggcaaagagttcatgacacagatgccaaaagcaattgcaacaaaagcaaaaattgacaaatgagacctaactaaattaaagagcttctgcacaacaaaagaaactatcaacggagtaaacagacaacctacaagatgggagaaaatttttgcaaactatgcattggataaaggtttaatatccagaacccaaaaggaacttaaatttacaagaaaagaagaaaagaacaaacaaccccatcaaaaagttggcaaagacatgaacacttttcaaaagaaaacatacacgtggccaaaaagcaaataaaaatgctcaacatcactaatcactagagaaatgcaaatcaaaaccgcagtgagataccatctcacatgagccagaatggctattgttaagtcaaacaataacagattctggtgaggttgtggagaaaagggaatgcttctgcactgctagagggaatgtaaattagttcaaccattttgggaagctgtttggtgatttctcaaagaacttagaattaccattggatccagcaatcgcattattgggtatatacccaaagtaatataaatagttctgcataaaaacacatgcacgtgtatgttcattctcaacactactaacaattgtaaagacatggaaccaacctaaatgcccatcaatggtagcctggataaagtatggatatactggataaagtatatggatagcctggataaagaaagtatgtatatttccaaagtaaatatacaccatggaatactatgctgccaaaaaaaaaagaatcagatcatatcctttgcagcaacatggatgcagctggaggccattatcctgcacaaactaacacaggaacagaaaaccaaataccacatgttctcgcctataagtgagagctaatcattaagtacacatggacacaaagaagggaacaacagaaacaggagcttacttgagggtggatgataggaagagggtgaggattgaaaaagcacctgttgagtactgtacttattagctgggtgacaaaataatatgtacatctaacccccatgacactccatttacctacatagcaaacctgtacatatacctctgaaccttatatatatatatatatatatatatttctattttttaaaaattatactttaagttcggggatacatgtgcagaacgtgcaggtttgttacgtaggtatatatgtgccatggtggtttgctgtacccattaacccgtcatctgcattaggtttttctcctaatgctatccctcccttttccccctaccccctgacaggccccactgtgtgatgttcccctccctgtgaccatgcgttctcattgttcaactcccacttatgagtgagaacatgtgctgtttggttttctgttcctgtgttagttttctgagaataatggtttccagcttcatccatgtccctgcaaaggacatgaattcattttttatgcctgtatagtattccatggcgtatatgtgtcacattttctttatccagtctattactgaagggcatttgggttggttccaagtctttgctgttgtaaatagtgctgcaataaacatacatgtgcatgtgtctttatagtacaacgatttataatcctttgggtatatatccagtaatgggattgctgggtcaaatggtatttctggttctagatccttgaggaatcgccacactgtcttccacaatggttgaactaatttacactcccaccaacagtgtaagtgttcccatatctcaacatcctctccagcatctgttgtttcctgacttttaaaaatatcttataaaaggaaaaaaagaattaaaaaaaatgtgatttgcaaagagactaatgtgtaggctgccttgtttgtagtagtaaatcatttcagagagaaggttaaagagatgataggcattttcaaagaagtaataaagtctttatttagtagatacgtgtaagacattgaaagtttattttccccctacattgaataaaatgagtaggtgtctatatttctgcctccatacattttaacaagtaacattctaattgtttttcaagattgcttgccatgtttctatattattcttgatatttctcttgattccgaaaacctaaaggtattcttcttcctcttcccagtcatttgtgtgtactctttctctatataagaaactttgacttttgtcataattcattatatacttctggcctaatttacagtaaatgtaagttttctcaatgcagagtcaatttccaatgacttcattcccgaaacctttgctactgtcttttccatggagtctatacccagtatttaacgaattaaattgaaaactaaatactaaactctagattttattgcatatcacctttcttcctcctccacacgccctttgataggaataggatagcaggtgctcagaaatatttttgcttctttctcaatacaatgtaggcatctattttgacattctatagaatagcaaggtcattcaatcaatggttatctgaatatcctctcatctgcaattctctgggcatgggggaggagagaagagagatgtagagagaatatttcattgctctttctattgttataaaaacaatctaatttaggttcttccttattaaagccctgattaaaaataacagtaaaataaatcatatacgactcatttttaattattctgtactgtaatagaagggttcctgttatttgcaaagtctacaaatattggtcagtaaattaaatgatgaattctgagaaaaatcccatctaattacatctagataaattgacttagtgctgaagtgactacttaggagcgtcagtagcatcctttctataaattatgcctccaacagagtatattctacttcttttgcataggaaaaagttcttcatagtcaccctggtagtgactactacaagagatgtgtggcagtttaaaatgatgctttaagtagatttaatacctattatctattttctcttgatttttctgctgccccgctatattattttttctgctaggaaacttgaagggcatctatacaattttaaaaggacacactttagaaccaagtgtttctggctttagaacaaagcaaataatatatgaacttgaaatcattagaagttttgttcttgtgaaaaattcaataaaatatacaatattgatcattgacccaaaatgcctttaatagtttctatttatatgctttcatgttaaaatataatttttttttacttttagctcaaatatcttattcatgaaggcttctcttgaagagacaattagtataatcaaatatcccatgtcctctcttacatttcccagctttcctgatagtgattttgaagtcatgtgacttgttctgtccaagggactgtatagttggatgcctgtcatttctaggtttataactattaagtgctgttgggcttctttcattcctgctttcttgtgacaatttatactaagtgtaaaagatgatgtaaggagaagagggaggagggccagctaaactacaatcagaaagataacacttgattgtagtaacacactgagtttcaaggctttgtctgttttgacacttagccttatttatcttaaataacatccattccctgattactttcaatgtacaacccaactttccaggtcattctatcacccttttctgttttccttagcacttgttaccatgtaacatactataaatatcactttattttctataaacttcaactagatcaaaagctccataaagcaagaatgcatttttgtttcagtttagtttactgctgtatccctaaaaacttgggctgtatctggaacatagtagattctccacaactttgctacttgaggaagttacctaatttcttagcctcaattatccttcttatcgtatagtcaagaagataaatgagaacatgtgtaaatcttctagtttcatatgtagtatacatttaagacatttaatggatgaatattttaagaaaacatcaccatctggttataagataagctctaccataaattttctcaagatgatcttaaaataaattttgagctatacaccgtaacatgtttgtccaataagtaggattcacgctttttatttgtatcactgttctttgcaatttatcaagatacaatgcaaacatgcataaaaacacacatatttttatacacacaaacataagcacacacatatgtgtgtatgtttgcctatgtgtgtacatatgtatgtacctgtgtatgtgtatttatatttgtataggtgtgtgtctatgcatatatgtgtggatatatatttatatgagataaataagtaaaccttatttttctaggtatcatctaataaatctgcagtttcaattctcaatgctgtgagaggacaaagaaatgtaaatgtatgctgaataaacatcggcttttcttgaggataaatgtgaagggcaaaaaaggtagagaagaagtagataatatgacagttactgctctgagtatacaatgtatatactctaaagttatctttgttcatttgacgtatcaaatgcaggcaacattttgccactcttctagcagatgtcaatgcctatcaaaagatttttttgaagggtgactcaacctaagaagaaaatcaaagtaattcaacattatctgcagtaacacctaaaactcattcctttctgctaaaatactccctgaagatattttttcatcccagaacatttctctcatactaaacactaatatcagtaatacattttaacgaaaatttatttcataataagggaaaaaatggaaagaaggtaaaataaaattattaaccagcattgtgcttgaagacattctgaacaggtcagaacagaaataaactttctaaatttactcagagaggaaacaactatacagatacagaaatatattttagttctgacttttaatatattttacctgtttgaagagaaaaacttctacagagaatggaactaaagcgaacatttctgaatcatacattttattgtgtgaaatgtccttcattttcacattgttatttacagtttatttcagaggaagttactgcatcttaactctcacttaaccatgaatgaaggaggtaagagaaaataatagaaataaatgaaaaatacgtaaatgaagaaagatcattaggtgtacactcagtagagctatgtaggtggagaggtttcaagggatcagagacctacatatgagtattaatactcatggtaattatattttctactaatgttttaaaggcctcactgttacacactaaaagtcatgaagaatgagatttcactaaagttttatagaattccaaacaataattttccctacatagtccctttactgtgaagcagtggaaaaccgagaaccaaaaccctcagatgactgatttttataagggccattgccatattctgttttacctgctgagtgtttgagtgttttcaaaggcaatgtaataccagaaatgaagcaccaaaccagactaaagcatccatatgccctagattttctgtgaaaaaattgcagtgctggattcctgctttagacgatattccctgtcttgtcaaaaataagcccaaaatatcaaatttcaaaattcacagataaacttcagtcctcataaaaaaaataaagttgggaaagaaagattgaaagtacactaaggcaaatccttaggaattttcatgtgcctttaaaaataaaacaagttaagtcaatctgcagcataaagaaaatacaaatgacatctcattgggcttcttttcatacttgcttcaatgacagttttattcttctttattgatgtgctgaggatgctcacgagcttttctactttcatttggaacaaggttatgaaaatttaaacatattgcttctaaatacattttcctttctgccaacttggcagtatttaccccaattttatttcccacctctttgttgcatatttagtggactcacttcgatttcagtgattctcataggttgctattcattaaaataatcacttcaatgaatgatacaaaatattagtgttgagggaaggcagagaagtgaaactagaagaagaaacaacaagatccatcacttttagtgatatgaaaaaatgatatggtgacaattcttttatttgtctattcttaacaaccagctattaagctaggttccatttggaatatatactgttaaaaatagtatacagaagtagattttacatattctacaatttgcacaagggaatttattttggtacatcattaatatattgtctagtgacaacatatctaactcatgcagagaagacgaaggaaagaagaaagagaaatggagagagtgaagagggaaggaggaaatgaggaagagaaaacaaattgcatagtgctgtcacactcactattcccctatgtacctctctctcctcaaggaactaagagaaaagatctgtagtttcttttgcaatttcagctcctgagccctttcttgcatagtgtccatctacgaatgtgacctccttgtcatgcaataatttatagtagcttaagaattttcaatattaatttaagctgcactggttttccacgttacgctctgagttccgaatcaaactcctacttaaagtctgactccagtgtactttctaatcttaaagaatataaataagaattgtaatgataaaatagatgggggattattgaattgttaattgcctactagtactacagtgtaatattgcagatttcaaatgtgtaaattagacaaatgaaaccaggctcaacgaatttttcggatgatggaatgagataacatacattaagtccctggtgcagggcctttctcataacatgaaaacaaaaatctgaagttaatatgattatctgcaggtttgatatttatttttctcttgcctggatcagcattaaatctttacataagtttagaaagtttgcataatataaataagctacctaagcaggttgcatctttaaagttcatttgccaaaaactttcatagaagtgagaaaaacatttctcataaaatattaccagttgttatgactcatattaattgaaagtctactatgtcttagatttggtaataagagctttatatgtcattttgtttaatcttcatagtaattatggaaataaatatttttcttttatagatgaagcttctgaggtgcagagagctatagtaacacatctaaggttaagtggcaactgaagtatgttatgatgctgttatgacacatattaattgaaggtctactatgttttagactctgtaatgagagctttatatgtcattttgtttaatcttcacagtaactgtggaaataaataattatttttattttatagttgaaacttctgaggtgtagagagctatagtaacacatctatggttaggtggcgactgatgtatgtccgactttaaaaccagtgttttgtttacagtcagcttacattagttgatgatatataccatagagcatatagcgattatgcatcatcttagggttagtgtcagtgcttcctggtatcctctatctatattattgttgtaatgaagtgctttttatacactgaaaatggaatatgtcagcattgttgaaacatggcttccattttgtaattcccagagggacccgtttgtaatttaacagatattttcctataaagaacaaagtatgcctgatcaagtaataaaaatctctcataataattctcatatccacttcaaggaatatatatatatatatacacacacacatatatatacacatatatacatctatatatatacacatatatatacacatatatacatctatatacgtacatagtagtttaagaattatcaatattaatttaagctgcactggttttccacattacactctgacttctgaatcaaattcctacttaaagtctgactccagtgtgctttctaatcttaaataaataagaattgtaatgataaaatagatgggtattattgaattgttaattgtatataaacgtgtgtatatacacatatatacatatatacacgcatatgtgtatatacgtatatgtatatatacatatatgcatatatatgtatatacgtatgtatatacatacatatatacacacatgtgtatatatgtgtatacacacacactttttttttgcatttctgcattatcaccaaaactggtttgattagcaaaaactagtcaaacacagagtcaaataaatgaccatgaatattataccttccttaaataatacttgttttttaaaaaaactcataaatataatttttcgtaccctggaatttactataaattgtctattccactggaaccaaagacatctgatgtttgaggcactagtgacttcccattttttccagtttttctcctttcagaaccataatggatataaacccacccacttcagcttggttgagattacatgatttttttgaccaataaaatgcaagtgaaatttatatcattcttgatctttgtgagatcaaatgaataacataagtatcaagtgaatcatacatttaatcgtaagtaccaaatgaataacatgccgattctgaagagcatccctgagccttcacatggaaaatagttgtcttggattgttaccaagagccacacagacttgatgtaaggaaggaaaaacatggtttttgagtcactaaaattttttgtttgtttaaaatttttaaataagtaaatgatacacttgatgtaacaggacactacatcagcacagagaagtgaatttcactattatgtaggaagtaaacattttcaataaaatatttaccaatgacaaacattagtgtgtataattatgtttccatataggtagtaattgattacagttgtttcacaagtcacattctatattcaggccaaaatattgcaaatatcttaaatgttatacctagcagttttctaactatgtgaatcatgggttttcttattcccctccacatccttaaagtttttcaaaaattatttttactttcaaattttaaatttgctgtcaaaaattctctcatgtgtagtataaagatttaaaatcaagagagaccgtattctatgacatatatgtatgtgcatatatacatatatttcatatattttatgtactgcatgtatattatatacatacatgtgtaaattatataaaatataatacatacatgcaaattatataaaatacatatgtaaattatttcccaaaggaaaaccctgataagatttttgttattaattacattatggtaaaaaaaaaacactaacagaaaacaaatattcatacaagataaatttttagcaactggctatgtccatacaaacactaccaccataatttacaaaaagtaaatcaaaatagacaatggtaaaataaaagaaagcacagtgctttttggattctgaacaatcagaattttgtgtatttaaaagtcattgtatggtagcaaatgactaactgacattttctttttcaacttttaagtttgaggtacatgtgctggtatgttatataggtaaacttgtgtcatgggggtttgttgcacagattatttcgtgacccaggtattaagccttgtacccattagttatttttcctgatattcccctcctcctatcctctaccttccagtaggtcctactgtctgttgtgtctgttgttcccctctatgtgtccacgtgttctcatcatttagctcccaaatataagtgagaacatgtggtatttggttttccattcctgcttttctttgctaaggataatggcctccagctccatccatttccctgcaaatgacataatattttttatggctgcataatattccatgctgtatatataccatattttctttatccagtctactattgatggccgtttggttgactgtaagcctttgctattgtgaatagtgctgcaatgaacatatacatgcatttatctttatgatataaggatttatatccctttgggtatctacccaggaataaaattgctgggtcgaatgttaatcctttttcacgtctttaaggaattgcactttgctttccacaatgatcaaactaatgtacacttccaccaacagtatataagtgtttctttttcttcacaacctcatcagtgcctgttaattttttgactttttaataatagccattctgactggtgtcagatggtatctcattaggattttgtttctctaataatcagtaatgttaagcttctttatatgcttgatggccacgtgtatgtcttcttttgtaaagtgtccatgttctttgcccactttttaatgctttttttcttataaatctgtttaagtttctcatagattcaggatatttatcagatgcatagttggcaaaaattatctcccattctgtgggttgtctgctgattttgtttcctgaaaatttgctgaagttgtttgtcagcttaaggagcttttggaccaagactatggagttttcgacatacaggacaatggtgtctgcaaagagggatcgtctgacttcctctctcaatgcccttcatttctttctcttgcctgactgctctggccaggacttccaacactatgttgaataggaaggtgccagagggcatacttttctgtgcctgtcttcaaggggaacgcttccagcttttgcccattccgtatgatgttgactgtcagtttctcgtagatggctcttattattttgaggtatgttccttcaatacctcgtttattgagagtttttttttaagcatgaaggggtgttgaattttatcaaaagcattttctgcatctattgagatagtcatgtggtttttgtctttagttgtttatgtgatgaatcacatttattgatttatatatgttgaaccaactttgcatcccaagggtaaagcacacttgaatttggaggatatgctttttgatgtgctcctggatttggcttgccagcattttgttgaggatttttgatttgttcaccaaggttactggcctgaagttttcttttttgtcatgtctctgccaggttttggttatcaggatgatgctagcttcatagaatgagttagggaggaagactcaaccaggaagaagttgaatccctgaatagaccaataacaagctctgaaattgaggcaataattaatggcctactaaccaaaaaaagtccaggactagacagattcacagctgaattctaccagaggtacaaggaggagctggtaccattccttctgaaactattccaatcaacagaaaaagagggaatcctccctaactcattcgatgaggccagcatcatcctgataccaaagcctggcagagacacaacaaaaaaagagaattttagaccaatatccctgatgaacatcaatgcaaaaatcctcaataaaatactggcaaacagaatcaatgatagactggattaagaaaatgtggcacatatacaccatggaatactatgcagccataaaaaaggatgagttcatgtcctttgtagggacagggatgaagctggaaaacatcattctcagcaaactatcacaaggacaaaaaaccaaacaccgcatgttcttactcataggtgggaattgaacaatgagaacacttggacacaggaaggggaacatcacacgccagggcctgtcgttgggggtggcgggggagtggggagagatagcactggggggagtggggagggatagcattaggagatatacctaatgtaaatggcaagttaatgggtgcagcacgccaacatggcacatgtatacgtatgtaacaaacctgcactttgtgcacatgtaccctagaacttaaagtataataaaaaaaatcaactacttcataaatctccaaggtaataaaactgtaacctttaaacactaaataaataaaaataaaaactgaaaaaaaaaaaagaatgagtcagggaggagtccttcctcctcaatcatttggaatagtttctgtagaaatggtatcagctttattttgtatatctgatagaattcagctgtgaatctgtgtggtcctggcctttttctggttggtaagctatttattactgattcaattttggagcttgttattggtctgttcagggattcaatctcattctggctcagtcttgagagagtatatgtgtccaggaatttattcgtttattctatattttttggttcgtgtgcatagaagtgttcatagtagtctatgagtgttttttgtatttctgtggggtcagtagtactatctcctttgtcatttctaattgtttttatttggatagtctctcttttcttctttagtagtctagctagaattctattttattagtttttcaaaaaaagaccccacaactcctgaattcattaattctttgaattttatgtctcaatcttcttcatttcagctctttttgattatcgtttgtcttctgctaacatggggttggtttgttcttggttctctagttcttttagttgtaatattaggctgttaaattaagatctttctaactttttcatgtgggcatttagtgctataaatttccctgttaacactgccttagctgtttcccagagattctggtatgttgtatctttgttcacattagtttcaaagaatttcttgatttctgccttaatttcactatttacctaaaagccatttaggagtacattattcaatttccatgtcattgtattgctttgagtgaatttcttagtcttaatttgtaatttgattgtgctgtggtccaagagattgtttttcatgatttcagttcttttgcatttgctgaggagtgtcttactttcaattatgtggttgattttagaatatgtgccatgtggcagtgagaagaatatatattctattacttttgggtggagagttctgcaggtgtctatcaggtccttttgattcagtgctaacatttggtattaaatatctttgtaaatgttctgccttgatgatctgtctaatacatttggtggtatgaagtctgtcactattattgtgtgggaatctatgtctctttgaatgtctctaataagttgctttatgaatctgggtgctcctgtgttgggtgcatatatatttagaatagttaggtcttcttgttgaattgaaccctttactattatgtaatgcctttctctttttgatacttgttgctttaaagtctgttttgtgaagttagggttgcaacaaatgctttttgttttccacttgcttggtagatttttcctatccctttattttccacctattggtgtcatgcaagtgagatgggtctcttgaaaacagcatgctaatgggtcttggtttttcatgcagcttgccactctgtgccttttaattggggcatttagcccattttcattcaaggttagtagtaatatgtgtgcatttaatcctgtcatcatgttagctggttattatgcagattttttctgtgtggctgctttataatatcactggtctgtgtacttatgtgtgttttttagtggctggtaatggtctttcctttccatatttagtgcttccctcaggatctcttgtaaggcatacatattggtaacaaattccctcagcatttgcttgtctgaaaaagatcttctttctctgaagcaacactttcatttgtaagcatcacttaatatgttaaattcttttaaaactattttggatcaaaacccaaattacaaatagttacaaattttacttcatccatgtatggagaagaatggaaaaatatccatagtgaggtaaagctagtacctactaggtaacaatctgatgggttcctcatgatttctttgcttacactaataatgttctgacctctcctaatacattctacaaaaaaatcatttactatagacaggaatcactgatttgcttcaactgccatctcataagaattaagtacactgtgatggtcttatcctgtacacagaatgaaacaccccatttcttgccacacagttgatttcactgctggaggaaacttcaatcaaataattatctcagccttcaaaaatccttcacaactgcattaccaaattaaaacattttattttaaatgtcaaaatactttttaacatgcaacatttggatagtgaaatttcttttttcttacattaataacttaccactagtttaaaagtttaactcagaatgaataaaatctcttcattagctataccattgactaaagctaagagattttatcaactcattcttagatgttatgtgatacttggtggatgtttgtgtttggtaacaaagaataatttttgctcaattcttatactcattacacttttgtgcacagtttatttagaaaatagaaaagactatctatgttgtaaagtattatgaatccctaagacaagctcattttctgccacatggctgattctttaataacttgacctaggaatggttactactagggattgttgtaaaactggagaattatttctctatatttcccttttctctgatagcaaacagggtcttaacctggccaaggattccttgggctgctacccttccttctccccaaatttggtctattttttaaatgagaagcgctttgttaccatggcaaaaagttttatataaataggtttatagagcacctactttagtctagcatttgctaataagtatcaaatgaataacaaaagcaacatccatgcagtcatatttaacaaaggaaaatatatattcaaaatcatattctaaagagccacaaaaatgcaggatataattcaagagcaaatgaacatcaagtattcaactgagcattgattctgagtaaatcagagtcttgttatttttgtctgctattctctttagagctccaccagtaaaaagaatgggactacatacatcattgaaggatacatagggatagattggaaatcatgggtgtgtctgtttataatcaataaattgataaaatattaaaagaaaataaagcagtactctataataaaatatagcacaacttctaaggaaatttttaatatttaattgcaaaatcaaaagacaacagtttgcaaaatgtctttgaaaacaaacaaaccaaagctatttcaagtaattaccctatattttggtgtctcacattttctgagtattacttatgtgatgaatgcaatcaaccaccaagatctctcttcaagaaaggacttttttcctccagctttcatctgtcatccacttcagggaatccctttgctgcaaagagacaaattgttcaaggttacacccttcccatgtcagctggtatttaaggactgatggaggcaggattgtgaacttccagccatttaggccaattacaggttgatcctggctccctggagctccctgtggtgatgactgaagcccagtatcacaaacgactggtcttttcttgatttttcacttacacagggtttgatcagtaggtcatcagttaataaatatcctacaaactaaaatccaccttatagttagctcctggaggacctaagtgaattaagagaaggttaataaggtagttgcaggaacaactccattattgtcaatttaaaaaggtatttgagtcctttagtacttagcattgccaaacattaggttatggatagtaaggaaaacttcattcattcagacatattggagtagaaggcttatctgagtttgaaagcttaaaactcataacaaaaccaccataataggtggaacacatgatggtggtcacaacataagcaaaactgtatgtgcgcgtctccgtcttggcctgagaggaccaaagctatgaggggtcaaagtagtgatattattcttgatttttgttgggatgtttctttccttgccaagtcttagactccaggctacttatctttttgactattccctgctttccaaatgtaggcagatataccaaagatgttggcaaatcgtgacggtgtgggtttccaaccacatgaaagcttcctgggcctccttccccatccttgcacctgtagccaccgtcagtggtgtttggaggctacagctgttccgactgatgctcataggactcatacatggtatgtcatctgtattcgtggtgaaaaatggctactgaacaacttgcacaatggaagtctactcaagctgcctccttgtcaaattaacatactaacagcagtgataaaaatgtgaccttcaacctgccctgtaatttagaagtactaaataacaaatgtcgtggtcaaggaaatgcttctcatgccagtctaatgattgtttttagaaaaggatatacattgaccttcaatgtaataagaaatgcaacactttacggtgtccaactgctaagatttatttccaacttgtcagacacaactattttgcccaatccaaatcaaagggaatcaaggctgtgaaatccacacaggacatcaacgcacacataaatgaaaactacagatgtgtcagaggcaaccatatacacacaaataatgtaactactaaattccatgaagtagctgtccaggaatactttccaaataacttcagcaaaaaagaaacactatgaaagcataaagaaactttcctaacaacactaccaaggccaaagcctaccaggtccccatcttctgcagggccaaaatgttcatgtgcttaataagtacaatatgagtagcacaagtgggaccagtctgcttgtagcatgaggtgacaacatcatcacctatgagaaaagacacaagatgactgtgacaggagtattaaatatcaacccaaaggagaacaatgacctataattctcatttagtgccactggaaatgcagtgaaaatgtcattcttcctgtcttcagttttggaatgaatgcaggttctagcctgtttttcccacaaggatttcagttcaatacagttctaggtgacaccagaaatctcatgtttaaagcttccaatgactcactgagagcctttcaagccaccagtggaaattcttttaaatgcaatcctaaggaaagtgttcatgttacaaacgccttttcagtaagcatattcaaagtttggatgctttcaggttttttgtttgaaggtgacaagtttggatctgtagaagaatgtcaaccagatgaaaatatgatgagttctgttgccagcggaggccctcatacagggattgtcttcattgtctcagttgcttatctcattgacaggaacagaactcatgcctggcatcagacaatttagcattctaaattactctctaccactgtagatcaacagtagttgccagaagtctatattcattttccctgtgattaaattggcagtgaaatggaggcaaactttcttgtaaaccgtttttctaaaacctgctttataaaatgtaaagtatttttttataaagtaagtaaagcaaaatttacttactatgcacaaaagagaattgaaatagtggtgttagttttactaactggttaaatattaatatttaccaaagtagaactcatagagaaggggaagagtagttttttaaataggcactgacaacatcatttaactccatcatttaacttttttgttgttgttgttgttgttgagacggagtctcgctctgtcgcccaggctggagtgcagtggcgcaatctcggctcactgcaagctctgcctcccgggttcacgccatccttctgcctcagcctcccaagtagctgggactacaggtgcacaccaccacacccggctaattttttgtatttttagtagagatggggtttcaccgtgttagccaggatggtctcgatctcctgacctcgtgatccaccagcctcggcctcccaaagtgctgggggggatatactcttaaaggatcagtacatatgcaatgcattacctttaacagtactgaccaaattttctttttgtttgtctggaaacaacaacagcaaatggcaattatcatttatccatgggccagacatcagacagtgaaatttacatttgttatcctgggttatttccttgttatctaaatatgcttcttatcattttacacataaggaaagtaacttccatgttgttacatggtcagcaaataggatgaccggagtttgagtcactatcttattaagcttaccattcattatctaggccttgtcaaatgtacacactgccttcttctgtgacagggaaaaattttaaataaatacattcctactatttctgagtatatacctaattgtttctaggttaataaattcgtatcttcttggcctgctataagacttttttttttctcagagtataataagctctcactaagaagaagtctatgatagacaactcctaccactccttcatcattaactggacagttttcacttacctacacaatctttcctctctgccatatgcctcaggcccaatactgattgttctccacttcagtagattttcctagacattccaggcttttaatgccctattgttccagcttgctgtctatttcacctccccatcatctccaaaatattttgtttcctgtggaagcagagctggtatgaatgcaaagaggttcctaaaacgtacctatctcaaagggttacagtattttctgtgtgatactccacaaataattcaaggaaattcctcttttgtttaaaaaaaatagggaattttaaaataaaaattatgacaattctacttctatttattttatttacctttttacttatccaggcccattcttcatacagtgcaggttgaatgactatgaggtttagaattctacactaatgtacagtgaaggcactcttaatctataatacaggtgcctattgttagtctacctgcccgcatacttatcaatccatttataatctatttctctaatttcttccgttaatcattctgttttaggggtaatggtggcaaacagtgaggagaccagagtaacatttgtggcaaaaatgaattgtgccaattaaggatggctttctctaagtatatggtttacccttatacaattgagctctttatctatctctaaagttaagtggaagtttctgaagaactaataaaaagaaatcatttgtatgaggagatgaagcttcttcgtcttaaagtgctttaaaaatagaatttggaagcctacttgaagacaagcatacgccttttctataaatggtgctgggaaaactggaaatccatatgtaaaataatgaagttggacccttaccatacaatatctacaaaaattaatttaaaatggatcaaggatctaaatataagagctaaatcttcaaaactctgagcaaaaatatagggggaaatcttcatgacattagatctggcaacaatttcttggatatgccactaaaaacacagatgacaaaagaaaaaatagataaattgagccatatagaagttaaaaattttgtgcatcagatgacattatcaagagaataaaaagggaacctataaagtgggagaaagtatttgaaaataatgtatttgattattgtttaatatgcagaatatataaagaaccccaactcaaaaacaaaacaaaacaaaaagctaacaacccaatgtaaaaatatgaaaagggtttgaacagacatttctccaaagatatacaaacagccaataagcacaggaaaatatgcccaacatcactaattaagaaactgcaaatcaaaaccacagtgagataccatttcacacccattaggatggttaataggtaaaaacaaacaacaaaaaataataagtattgtcaaggatgaagagaaattggaacaactgtatactgctggtagaaatgtaaaatggtgaagcctctctagaaaacagtatggtggtcatataaaatgttaaatatgggattaccatatgatccaacaattttacttctgggtatatacctacaagaatttaaaaagcagggactcaaagagatatctgtatacccatgttcacagcaatattatttacagtttacagtaggtgaaagaaacctaaatgttcatcaatgggtgagtacagaaacaaaatgtggtgtgtttgtgtgtatggttacagttgaccgttgaagaaagcaggggttaggagtgctgatcccctgcacaattgaaaatatgtgtctagagggttccagttcaagataactaactagagacctcaggcggcagttctcacaaagaagaaagttacaagtgaataatcataacttgaataaaatagcaaggaagggtgctggagtctagtgaagaactcctgataagaagttggagcacagaaaaaaaggaagcaaggcagtggcagagatcagctaggaaccctaagcgactttttgtgttttgtcataagggtaagtgggagtattttggctgcccttgtccccatggcagatcactggtatctgaactattggagagctcacctgccttcacgatcctaaacactggtgtggacagcaatttggagatttcttaagggcactgcactagaataccaactcatactgggttgtttgccctctccagaggcctcagaagtggtggtgttgcataatacttaagaagcagccatcggcagactatgtcctccccctgaacctcagcccatgagtctccacgtcaccagagccctcatagacattccctaatacccacttggatggtggcagccacgcagggctgccaggacccatgaaagcttctggattcccagtggttttgtcctcaaggagtcttctcctaagggaaacgagagcgcagcacactgagagaacacttcttggaacaaaggaaaccagagtgcatatttttctgtgcttgagagctccccacttgtttgggcactgtgcacggccaggcaagggaggaatttagttccatcccagtggccaagcagcatttatgcttgtacccaggcgtggagaaggaagcttttcctcctcctgctacagacacagccatggctgctcctatgggaaactggcagaagtgcaaaggaggatagtctttctgggcttttaaggggaactgtgtcctcagaggtagtgtggccactgggcaaggtttgtgtgaaaggcaaggctccttcccacctctacacagagtgacagtgttcctgaaactgggagcagaaaagcagaaggctatgtgttttgggctgagggaagaagtttctcactgaagccattttagtggtgagccacaggacaggcatcttttacggctctcagctacattgcatcctggtgatagataaagatgtctaactaatgtgtgttgaaaacaccagggctgaggcatgacagggaagtagattgcattcctgcctgctgagggtatggagctgcatcagttgtctcccctgctgcagagatttcagtgcatttcactgggagctcccttgccatccacatcagggatggtgcttgtactcaccattgggggatatgagtgtgggtttgcctagtccagctccacccagctttgtactcttgctctggggctgaatggggagctcaggccactgtgcattccacagaccagcccaatgcctgagccaagagagagtttttccaggtaaacaaatacgtatcatacacccaactgctactgctgcaccctgctgttatctgtaagtgttacgtactggcctgatggttgaattgcacaacccaatgcaaattctgttaatagaagtgcacagtgcttgggaatgagataagctacttaaggccttcactatcctggccttgcagaagatcataagcctgctaacgtgcccaatatactgctattacaaccagcatttgagagagctaccacactaaggctatctataaccaagaaactcatacagagtcattgccatcgaaagtacccagaaccgaagccaaaccaccctatacaacatatgttatactcatatcctcaagtgaacaaacaaataccatccaaatgaaagtaaattcaaaaataagaagggctattttctccaaagaaaaacaaagcagcaaaataattctagaagtatgaagaaacagtgttatgatgccctcaaaggatcacagtaattctcttgcgaaggattctaaccaaaaggaaatctttaaaatattagataaatgatttgaaatgttgattttaaagaagctcaatgagatccaaaagaaaaacaaatacaaggagatcagaatatcaattcagggtgtaaatgaaaaatttgacaaaaagatacatttaaaaaattctaaacaggaccactggaaatgaaaaatacggtgaaggaattacaaaataccactggaagctttaacaatagactagacaaagcataacaaagaatctcacagcttgaagacaggtctttggaataaacccagtcaaaaataaaaaaagaatttaaaaaataaacaaagttttaaagaagtctgagaatatgtaaaatgttgaacctatgtgccatacgtattcctgaggacaaagaagaaacaagaagtttggaaaacctatttgaagaaattgagaaaaacttccctagacttgctagagatttagatgtctaaacacaagaggctcagaggactctaggaaaatacaatgcaagaaagacggtatcaagacatatagtcattagactatctaaagttgatatgaagaaaaaaattataaaatcagcaagagaaaaacatctaatcacatattttaaaaaatcctatcagactgacagtggacttctcagtagaaaccttacaagccaaaagagagggtttcctattttcagagttctgaaagaaaaaaatcttccacctatgaattttgtatcctattggaataagcttcaaaaatgaaggggaaattaagtatctccaggacgatcaaatgctaagagaatctgttactaccactagactgatgctacaaaaatgcttcagggagttctaaatatgggaacaaaagattgatacttactatgataaaaacacaggtctttaaactcacaggtcataaaacccacaggtcttataaaaataattgcacaagtgacactgcaagacaactagataataattaacattatgacaggaaaaacctcatattatcaatattaaccttgaatgtaaatggactaaatgttccactttaaagatatagatttgaagaattgacttaaaaaacattattcaaccatatgctgcttataggaagtccaccaaactgggaaagacacttatagactgaaggtaaaggggtggaaaaagatattccatgcaaacaaaaatcaaaggcaagcaggagtagctatccttatatcacatcaaactgactttaaatcaacaacagttaaaaaacaacaaaaaagacaaacaaggtaattatctattggtgaagggatgagttcaacaagaagatataagaatcttaaatatatatgtgcctaaaactggagcatgcagattcataaaacaaatactacaaaacctatgaagagatagacagcaataccataatagtggtagtttcaaacttcaccaacagcactacaaagatcatcaagacagaaaatcaataaagaaataatgggtttaaattggatttagaccaaatgaacctaacaaaaatttacagaacattctacccaacaaccatagaatatcctttcttataaattcatggaacattctccaaaatagaccatgtgtttgccataaaccaagtctcgaaaatttcagaaaactgaataatatcaagaatcttctcagaccacaacggaagaaaactagaaataaatctcaagaggaactctcaaagctatacaaatacatggaaattaaacaatctgctcctgaatgatctttgagtcaagaatgaaattaagacagtaatttaagaaattatttaaacaaatgaaaatggagacacaatataccaaaatgtcttgcatacattttaaaaaacactaaaagggaagttggtagtgttaaatgtcagcataaaaaaataaaaagatcacaaactaacaacctgatgtctcacctaaaggaaagacaaagtcaagaacataccaagcccaaacctagcagaggaaaagaaataataaagattagagaagaactaaatgaaagtaagtcctaaaaaacagtaacaaggataaatacaaagtttgttctttaaaaagataaacaaaattgatagactgcaaaactagactaaccaaaagaagagagaagattcaaatatgcacaatcagaaatgataaaggtgacattaaaactgacaccacagaaatatataatatcatcagaaactactatgaatgtctcttcacacacaagctagaaaatctagaagaaacagatcaattcctggaaacatgcaacctccaaagattgaaccaggaagaaacagatatcctgaacagaccaataatgagtagtgagatttaaccagtaataaactttttctcaagaaaaaaaggggtcagaaccagatggatttacagcccatttcaaccagacataaaaataactggtatcaatcctactgaaattgttccaagaaattgagaaggagggaatcctccctaactcgttgtataaagtctgttatcatcgtgattccaaagccacacaaagtcacaacaacaacaacagcaaagaaaactacaggcagtatttgtaaatgcatatggaggcaaaaatcctcaacaaaatatagcaagacgaattcaatagcaaatccaaaaattaatagaacacaatctggtaggttttatttcagggatgcaaggatggttcaattaaatgcgattaacctaaaaatcagaattaaaaacaaaaaacatataatcatctcaaaatatgcagaaaaaagcatttgataaaattcagcatcccttcatgataaaaccttcaagaaactaggcatcaaagaacatacctcaaaacaatggaagccatatacaagaagcccacagccaacatcaaactgaacaggtaaatgttgaaagcattccccataagaactggacaagacaaaaatatccactctcactactcccattcaacttattacttactggaagtcctagccagagcaatcaagcaagagaaagaaataaaaagcatccaaattagaaaactggaagacaaattatctttttgctgatgatatgatcttatacttagaaaactctaaatatttctccaaaagactgctagatttgataaatgaattcagaatagtttcagtatacaaaatctaggtgcaaaaatcagtagcattgctatatgccaataacaatcaagctgagaaccaatcaagaagtcaatcctatttacagtaactacaaaaaaaaataccaaggaataaattaaactaaggaggtgaaagatctttacaagaaaaactacaaaacctcgatggaagaaattgcagaagacacacacacacacaaaaatagaacagcagcccatgcttatgaattagaagaatcatcattgataaaatgatcattctgcccaaagcaatccatagattcaaagcaatttctatcaaattaccaaaataatttttcacagaattagacaaaaatcctaaaattcatatagaaccacaaaagagcctgaatggccaaaacaatcctaagcaaaaagaacaaagccaaggtgttacattacctgactttaaattataccgcaagctatagtaacccaaacagcatattattggtacataaaatagacacacataacaatggaaaggaatacctacaatcaactgacagtcaacaatgtagataaaaataaactatggtgaaaggacaccttattcaataaataatactgggaaaattggccagttataggcagaagaatgaaacttgacctctatctctcgccatacacaaatattaactcaaggtaaattaaagatttaaacataagacctgaaactataaaaataatagaagaaaacctaggaaaatctactggacactggcctaggcaaagaattcatgactgaggcctcaaaagcaaattcaacaaaatcaaaaatagacaaatgggacttaattcaactaaaatgattctgcacagcaaaagaaataatcaacagagtgaatagtcaaccagcagaataggagaaaatatttgcaaacggcgcatttgacaaatgactaatatttagtatctgcaagaaacttaaacaacaagaaataaataaccccattacaaagtgggcaaaagacatgagcatttttcagaagaagacatacaaatggctaataagcacgtgaaatatgctaaacatcactaatcagagaaatgcaaattaaaaccacgatgagatactatcttacaccagtcaaaatggctattattagaatgtcaaaaagtggcagatgttggcatggatgtggggaaaagggacacttacacactgttggtgggaatgtaaattgaaacaatctctatggaaaacagtatggagattcctcaaagaaccaaaaatagaactactattggatccagcaatcctactactggatatatttccaaaggaaacaaaatgtttatatctaaaagacatctgcacttgtatgtttattacaacattgttcacaataggaaagataaggaatcaacctaagtgcccatcaacagatgattagataaagaaaatgtctctctttctctctctcacacacacacacacaaacaaatactactcagccataaaaaatcataaaataatatattttgcagtaacatgggtggaactggaggccattatcttaagtgaaataattcagaaacagtcaaatactgcatgttctcacttatcagcaggggctatataatgtgtacacacagaaatagagtgaaatgatagaaattggagactcggaaatgtgggagggtgcaacgtggttgaggaatgagaaattacctaatgggtacaatgtacattatccaggtgatggttacaccaaaaacctagacttcaccactacacaaaacttccatgtaacaaaactacacttgtaccctctaaacctgtaataatatcaatacaaaaatctgtgtatcacttttgattccccaataacttacctactagtagcctgctgtttattggaagcttcacagataacatagttgattaacacatattttgtacatgtattatgtactgtattcttttattattattattattattatactttaagttttagggtacatgtgcacaatgtgcaggttagttacatgtgtatacatgtgccatgctggtgtgctgcacccattaactcgtcatttagcattagatatatctcctaatgctatccctccccctcccccaaccccacaacagtacccagagtgtgatgttccccttcctgtgtccatgtgttctcattgttcaattcccacccatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttcgaagtctttgctattgtgaatagtgccgcaatgaacatacgtgtgcatgtgtctttatagcagcatgatttatagtcctttgggtatatacccagtaatgggatggctgagtcaaatggtatttctagttccagatccctgaggcatcgccacactgacttccacaatggttgaactagtttacagtcccgccaacagcgtaaaagtgttcctatttctccacatcctctccagcacctgttgtttcctgactttttaatgattgccattctaactggtgtgagatggtatctcattgtggttttgatttgcatttctctgatgcccagtgatgatgagcattttttcatgtgtcttttggctgcataaatgtcttcttttgagaagtgtctgttcatatcctttgcctactttttgatggggttgtttgtttttttgtattcttacaataaagtaagagaaaacatgttatgaagaaaatcataagggggagaaatacatttataataatgtatggtatgtatcaataccataagagtatgtcatttgtttacaagatgaatcatctctgaaatggtggacaataacaactgcagacctcaatctacagtacatataaactttttcttgtaatgtgatgacttttctctgattctgggacgtacttccagcatcactagtagcacttcatatgggtcctatgatgttatgcagggtttatggttttccactaaacgtaatttaaaaatatgagaaccatgaaagatgactttttagtgtgatacacaatttactggagagatgaactgctcatttggaggtgattagcatcacatggatttttaagtgaatactccctaacacttgagtttaccacaacaggaggtggttatgaaattattagaacactacaatatgtactacaattaattttatagttttgatttaatgttgcatctttatatctgtgtacatttctctcaactgcaaatagtgccacgtacgatctgtgtgtgcataagctttgataaattttaaatttgtataatagatttgtgtatattttatgatagtatatgataaaatagactattatttgtatatatatataatgcattaataatttacctttttcttaatttcttttgatatttctaggctatgtggtttgctgtgagtttttttcaaatttttaaaaatctccaaaattttttctaatatatatattgaaaaaaatccacatataagcggactcagactattcaaattcatgctgttggagggtcaactacatatacagatatataaatacaataatgtatgtgtatatatagtatatacacatccatgcacatccaataaaatattattcaaccttaaaaaggaagaaaattctgacacattctataacatggataagtcttgacaacattatgttaagtgaaataagccagtagaaaaaggacaaatactatataaatcacttatataaggtacccagagtagtcaaaatcatagagacagaaagtagaatggttgttaccaggggatggagggaggaaaaaatggggagttttttttttcctgggtatggagtttcagtatgtgaagatgaaaaaattatttagatgggtggtggtgatagttgtaaaacaatgtgtatgtacttaataccactgaattgcacacttaaaattggctaaaagggtaagttttatattatctataatttaccacaataacaagatgagaataagattgatattgtgtttcaaaatatgggacccataaatgaagaaggaaaacattggaatatacaatactttgcttaacttcaaggagaagattagtaaccattcaactaactgaaatgtaaacaaattataatttaactctcaatctatatcaagataaaatttaatacatacatacacacacacacacacacacacacacacacacacacaaacacacatatcccagtcaggtggaattagagaccctcaatctaaaatcataatggtgcccaaaaatcaattttagctctcacacagtctttgagaatcaaatacaggacacagatttttctccgcagagaaaatcgtatatataaatatattaataaaatagtgccttctaagatcatggagaagtcctgacagccatggagtagaaaggaaattgtcatcccagatttttcttttttttaacttttaagttcaggggtacatgtgcaggtttgttaggtaaacttttgtcatggaaatttgttgtacagattatttcgtcggtcaggtattaaacctagtacccagtatttatttctcccgatcatatccctcctcccaatccccatgttctgattgtcccagtgtgtgttgttcccctctgtgtgcccatgggttctcatcatttagctcccacttataagtaagaacatgtggtatttggttttctgttcctgcattagttttctaaggataatgacccccagctccattcatgttctttcaaagggcatgatctcattcttttttatggccacatagtattcgatggtgtatatgtaccatgttttctttatccagtctatcattgatgggcatttaggttgattccatatctttgttattatgaatggtgctgcaatgaacatatgcatgcatgtgtctttataaaagaatgatttatattcctttgggtatatacccagtaatagaattgctgggtcaaatggtacttctgcctttaagtctttgaggaatcgccacactgtcttctacgatggttgaactaatttatattcccatcaatagtataagtattagtatagtataagtattctttttttcctcctcaaccccaccagcatctgttattttttgattttttaataataaatagccattctgactgttgtgagatggtatctcattgtggttttgatttgcatttctctaatgattagtgatgttaagcttgttttcatatgattgttggctgcatgtatgtcttcttttgaaaagtgactgttcatgtcctttgcccttattttattgtggttgtttgtatttttcttgtaaatttgtgtaagttacttacggatgctggatattaggcctttgctggatacatagtttgcaaaaatgttctcccattctgtgggttgtctgtttactctgctgatagcttcctttgccgtggagaaactccttagttgaattatctcccatttgtcaatttttgcttttgttgcaattgcctttggcatcttcatcatgaaatctttctccatggccatgtcctgaatggtattgcctaggttatcttctagggttttatagtttggggttttatattcaagtctttaatccatcttgagataatttttgtatacggtgtaaggaaggagtgcagtttcaatcttgtgcatatggcaagccagttatcccagtatcatttattgaatagggaatcatttctccattgcttctttttgtcagctttgttaaaaatcagatagttgtaggtgtgctgccttatttctgggttctctattctgttccattggtctatgtgcctgtctttgtaccagtgccatgctgttttagttactgtagccctgtagtagagtctgaagttggatagtttgatgcctgcagctttgtcctatttgcttaggattgccttggatattcaggcttttgctttttggttccatatgaattttaaaattgttttttctagttctgtcaagaatctcaatggcagtttaatgggaatagcattgaatctataaattgctttggtcaatgtggtcattttaatattgattcttcccatacatgagcatggtatgtttttccatttgtttatgtcatctctgatttatttgaggagcattttgtagttcttgttgtaaagatctttcacctccctggttagctctattcctaggtattttatttttttgtgacaattgatcatcctagatttttctatggctcacttatatgtaatgtaatctaaaataatgacctggcaaaataagagttcttgtttaatgttttgtttgatttaaagtaattttataagacagtttaagcaattaagattaactttatattttgactttttttaaaatttaaagcttaacggtttttcatgctattaattagatttcattgtactatgtcatttatgaagcatagtatacaagagcatttctcaactaataagctaatgaaaacatactttttaaggcatgagtcaaaaatgttctttttagtggcaataagatttgtaatgggggacactctcaccttcctgatcatatacacagataaaaaatttaaagaatttcattccctaaaccccccaaaaaaatcagtatatgatagtagaaccaggaaaacagaacagcatgcaagagaagaaaagggaagaaataaaaataagtaggaaaaccaaaatagagtgtaagaggaagagagaaggtgagagagagggcaagcagtaggaaggcataatgtcaagttattgtcatatatatctttgcattacaactttagttatttgactctttactggagggcaaaattatctcatctgctgttgcagctacatcaatctaaaatcacaatggtgctcacacatcaattatggtgataccaatgttttgtgacagcataatttaatcagatcactgtaattaaatcttccaagtcattaaatcaccttttacaaagtatattacttttatttcaattattaattcaatttaatgaacatctcatgctctctttcctatatattattttttaagttatcttatgtgcctccttataccctacaggttcattttaattttcaaagagcaatagattcaggagataaatgtattaaacaaagacatccagcacatcttgaaacatttccatgaagaacaatcacacaaattaaacagattttagaaaatatttaagaccagaatgtgtgtgaatatataattccaaagacaaagaatataaattttacccttggtgtcatacattttgactgacaatgacactaataatttaaaactgtaaatctcaaatgattaaaagaggaagaagacaaagaagtgaaagaagcaaaagggactactgccactactagaggatttcctagaagaaacagtaggagattttcaaaaaataatcatagaataagaaagatactttctagggtgacgccaagccttgaggccacaaataaaaaaagtttcatatattcagatatataaataagctaacattttacagaataaatttcagaataagcaaaggcaaaatgattaactggaaaaaaatcgtatttttaactcattgcaaaatgatagtttgtccccaatcccattactctcctcttctatagtattagtttcactatgcagaacatgtcaatctaaagactatatttcctagattcccaacatctagatatggccttcatcaaagttctgaccaatagtgtttgactgtgagtgaggcacactggttttgaatcttgcccttataacaactatgggtaggttcctctagatctctccattctccatctctggggacagtaagaactagagctgtcacattggacccatcattggaagccatatattgatccttgagctctgtgtgtctatcaaaactattatatgagagaaagaaaaagaaacttccagttcatttaagctactctattgggacatttttttaatatagcaatagaagctgtcccctaaatgacacattgttcttacattgttctttgaagtgataacttctctagtatttaaagatctcttttaactaaaataataagattaacaatgcaatagaaaaattagctaaggaaatagttcataaaaaaggaaataaaaattgatcttaaacatatgaagggccaggcgtggcagctcacgcctgtaatcctagcactttgggaggccgaggcgggtggatcacgaggtcagaagatcaagaccatcctggctaacacggtgaaaccccgtctctactaaaaatacaaaaaattagccatgcgtgatggtgggcacctgtagtcccagctacttgggaggctgaggcaggagaatggcgtgaacccgggagggggagcttgcagtgagccaagatcgcgccactgtactccagcctgggcaacagagcgagactccatctcaaaaaaaaaaaaaatatatatatatatatatgtatatatgtgagagaattgttaaatctctcacaaaagtaaagaatgaaaacagagattctattgagagggtattttgaactatcaaattgccaagaatctgagagcttggtaacatgttatgttcatgagcataaggggaaacaggtactcttacgaattgttgattagagtataaaagtgtaaaatgcacacagacacaaactttttgatattccacacctaggaactcatcatatacatatacacaaatgcaaagtggcatgtgtataacgtaatttatttagtcactgtttgttttagcaaaggatcacaaatcacctacgtatttattggcaggagactgcttgtgtaaattatggtccagatgctatagtttggatgttttgtgccctcaaacctaatgttggagatggggactagtgggaggtttttgggtcatgggggcaaatctctcatgaatagattaactctcttccttggggaaaagaatgagtgacttctcactctgctagtacccatgagagctggttattaaaaagagcttggcacctcccctctcttttccttttgtttctgctcttgccatgtgatctgtgcatacattggttctccattgccttctgccatgactggaagtagcctgaggccctcaccagaagctgagcagatggcggtagcatgcttcttgtccagcctgaggaatcgtgaaccaaattaaactctttaagttataaattacccagtattaggtattcctttatagcaacactaaatggactatgataccaaccaattaaataccatagagcactagaaaagattgagggaatcctttacacactaatatataataatctcaaagatatatattttactgataaaaggaaagaacattatatataatttagcatttatataaaattagggaaaacattaacttagacttgattatagtcatagcatatttctgtatttctaaaaagaaggaaactggtaaccttatatacctctactaaggggaagtagattattggtgtataggagtggaagaaactatataatttatttgtgacttataaattttaaatcatgtggccatattcttcaagcaaaaaataaaatataaaaatcaaagagttggtagaaccccgtatatatttttttcaatttttaataagatcaaaattttgtaccatgggatagaggctgtattccaaatactaaaggtaaaatacaactactacattaatcataatgttgattattttcattggtagagtaagataattattaatgcaatacgaagcaaaagtaaagcaattagaatgaatgacattcttaaaattttgctttaaatgcattaaaatttgaaatatagactttgagtttcaagagacaaatgatttttacaaatgggaggaaatggggataaatacatgaaaatacagatcatccatttgccctgtgaacattttcacccttatattaaatagcatggagtcttatattcaggatttggaattgaacttgcgtctactaacactaatgttcagtgtaagtatacactatatgttgaaggttaggttttcactcttgtatttataaagtatgatcaaagccccaaaaagaatttctaaaattttaaatatccatatgtattagtctgttctgacgctgctgataaagacatacctgagactgggcaatttacaaaaaaaaaagagggttaattggacttacagttccatgtggctggggaagcctcccaatcacggcagaaggcaaggaggagcaacttatgtcttacatggatggcagcaggcaaggagagagggcttgagcagggaaactcccccttaaagaaccatcagatctcgtgagacttattcactatcatgagaacagcatgggaaagacttgcccccatgatttaatcaccatccactaggtttctcccacaaaatgtgggaattcaagatgagatttgggtggggacacagccaaaccatatcaccatataacaagtgatataactttgtctttagataacccagtaagttttctaaattgtgtgtgtatatgtgtgtgtgtgtgattttaaatgtctaatgcctgggaaacatacaacaataattaatctattctgtacttcaacggagggggatcctacaatataaggcaaaattattacaccttatgatattcctccatttaaatgtcttcagcacaatagagcaataaagaaaatgtcttgtaagcaatgtaaattttcaggccccactccctgacctactgaattagtgactctgggagcagtagaaataagtattttaacaagacttcccagtgattacagtttgaaaactaccattttaatttaatgggaagaatcagtattaagtatcacctaagacaatattattttttggcatgagaccaaactaaaataataaatatctcttcaaaactttattgccaagtttgaaatatgatgtttgaattgaaactatatatctgtatcacataaattaattatatatatattatttattatataaacacacatggtacatatatatatatatatatatatatataaaattacataggctattttagaagcagaagttctctaacctggagtctatatatttccatataactatttttctctacaattttatgtataatagtttatgcactaaagtcaccctattttgaatatttgttcaaattgtggagatcaattaccatggaatgcacactgaggcatacgatgaggcattcaagaaaattgagacttctaaaatctaccacggttttggaatccaacacagctatgtccaatgcctctttaatcaataataattttaaaacaccatctcttcgtttgaaagaagcaatttaccttcatcatgcttcacacatacacaaacacacacacacatacacgtgtgcataagtttctttaaaaattttaactatgaagactaataaatactaaaatattatagcatgatatttaaaataggggcattttaaaaagagatatttatcaggttcctctttttcatactaaattactattgaaatgttctctcatttctatctctgcaatttattttaacccagtcatctctcttttattctttcctaaactttttgcactttacacagagtgtttcttttctcattatctgaaatccctgatccctgtgtcaacgcactcctaaattattctaaaccatctaaatgacttccttaatcacaggtctggtcctggttttcgtgggttcttcattagttcctagctatttatggaatagaggtaacaatcatgcttttagatatggaagggactttattcaatctgcttcattttacatgaaactgagacccagataggttacaaaagttcctggggtcaactcaacaaattattgttaggggagcactagagcactcagtcaactgatctcaattggcaatagcatcttaaattttaatccaagactttgaagtttcagattataatctaaagcacatcttcccatatttcctttcataagccttatgtatggatttatggaattatttactatttcctatacataccccaggtttactcacctcatgctcatgctctttttctctgcttagaaattcctttgttcctctcaatttttgaaaatacgtatctctagtattaaaggtccatctcatatgtcacctcctccattgaatcatttgagatctccaaattataagtggtctcttttctgagacctctcattacccttaagcaaaggtcataatattttctatctcacatgagtacttaatatatgtattccggccgggtgcggtggctcacgcctgcaatcccagcactttgggaggctgaggcggacagatcacaaggtcaggagatcaagaccatcctggctaacacggtgaaaccccgtctttattaaaaatacaaaaaaaaaaaaaaagccgggcgtggtggcaggcgcctgtagtcccagctactcgggaggctgaggcaggagaatggtgtgaacccgggaggcagagcttgaagtgagcagagatcgccccactgcactccagcctgggtgacagggcgagactccgtctcaaaaaaaaaaaaaaaaaaaaaaaaaaaaaaaaaatatatatatatatatatatatatatattccattcctctcttgaactattcttgaaagatttttttgtctgattcatatctataaccaacatagagcctaacagagtgtgttaggcatagtattatctgttaaatgaggatttaaattaatgaatcaaagcactttctccaattttaatgaacataattgatatagtacagctatattgtctaaaactgggaggttcttatatacttttggggactactgaatagtgctcaggtacgatgattttttaggattttggagagctcttctgaaagtgttctatccataaaaatcttgctacttaacattataaaataatctgtaataaacactatatcaaagcattaccaaaaaaattctgaagctgaagcttaggacaaactcactttagaatatatttacctgtgatcttgaagtaccacctggtttacctttaaaattaacattgttttcttgtgtggagtcagggtaagggctggtggacaccatcgcaaaacacagcgttgttgctggaaaaattggttctctattctaacaactaaatattacaacaaagaacaaactcaacttcaacaaaatgtaggctgaatttaataactcagatgatcaagttcagagtcagaatgggagggcatagatacaaggagtggaaaaattcctgacaattttttcttggtatctaataggagctctgtctcctgtataaatttttattcctatgattttgtagaggttctgttcttctaaccaaattcagatgaaggcaatagttgaatcaaggcaggtttgctcaagagtactcttctctatattacatttttaaatgttgcatatattatatcttatattatgttccatatcatttttaaaattttacttataccttttacaggctcattagtgatattacccatgtattcccatccccagtaaaacaaaattaattgtaatgagtaagacttgtatacattatacaagtaaaaaattaataggaaatagagttttgtaagcaatatggtggaataggaaggcccagaccctcatttctcccatggagacactaattcaacaacagtacatgaaaccaattttctgtgtaagaaatccagaaactagttaagagatttctgcaacccagaagaacatgaaacaaaacatgtggcaccctgtcatcatagcccctcccttcattatagtaccacatggtcaaaaagaaactcctagctccagattctccttgaggaaggaaagagaaaacttgacactatcttcttatgttatgacttttcaggggtctgtcaaagggactggtggctgtttcatcggtcttagagcaatgaagcgacccagcatattctagatgcttggaggttgttgagaaccgaaaagaaactggtgatatgttgcttctccagaggaacactggtacagctgacagggtgatacagctcagaagcattttccttagaaagaaggagaagactggagcatgtgcacaacactgtagcttttcaggaggctgccggaaaggctgatttctgtcttgcctgtcttagaacgcacacaggacctggactactctaaatgcctaggggctgctgagacttgaaaagagctgggtggtgtgccgctgccttagtggacctgcagtacagcaaatagacaccagagggagcacgagattacaagctcttgaaatacgaattctgcaaattgctctaaaggaatctacatgcgcagagaagatacatccacaggagaggtctgacaagcccccagaatttctagttgggtgattggtgaaggttttccctgtacaaagccagtttgtaaataatgttagaggtgtttgcttttttcaaatgcaaggataacaacacaaagttgtgaagaatataaagagggaaaacggctcaaccaagaaacaaaatgaatctacagaaattgatcctaaagagacagaggtataagattaccaaacaaataactcagaataatcgtcataaagatgctcaatgaagtccagaaaatgattcatcaacaaaataaaatttaaaccaagagataaaaggtattttttaaatcagtaattttacagctgaaaaatgcaaaaattgaactgaaaaaattagtagaggggctaaatagaagacttgattaagtagaatagaaacaatgagtaaacttgtagataagtcatttgaaatgatccagtcagaacttgaagacaggtcatttgagaaaaaaaaaacagaaaagaagaaggaaaaatagggaagaaagcctaaggagcttatgggacaccattaaacacaccaaaatatgaattatgggtgtctcagaaagagaaaagagagagaagggaaagaaagcttacataaagaaaatatgattgaaaactgccaaaatctggagaagaaaataaacatcagattcaagaagtccaataaatttcatataggatgaaacccaaaagaccacaacaaggtacattataatcacattgtcaaaacttaaagacagagaatttttaatgcagcatcactaaagtaatggagaagggaaccccataagataatttgtggatttctcaaaagaaatcgtatagggcagaaaagagtgagatgttttattaaagtgcgaatgacaaaaactgccaactattgaaatggtatccagcataactgttgttcaaaaataaagaagagaaaaagacttgaccaataaagaaaaggtgagctagttcaccaacactagacctgccttgaaagaccgctaaattgaatcctgtaagttaaaatgaacaaatgctaaacagcaagatgaaagtataaagctcactggtaaaggtaaatatacacacaaatgagaatattctaatactgtaaagttggggaataaatcacattttaataatttttaaaaatagttttaattatcatggatacataatcattgtaattatttaaggggtacatgtgatatttttgaagtccaaagataaggtacaaaataacaataaatataaaatacgttaatgtatgcataataaaaaagaatatttgtgacgataacataaaatgggtggggtatgtagaagaacagagttcttgtatgtgcttgatgttaaactgtcatcatcttaaaacaggttgtttataactacacaatattatgtgtaagcctcgtggtaatcataaagaaaatacctatagaatatacacaaagaaaaataagaaaataaaagcctgtctctaaaaaaacaaacaaaaaacacaaaatacccccaaatacaagggaatgtagcaagagaagaaagcaggaacaaaagagccacaagacagacagaaaacaactaaacagcaatagtaagcctttccttatcaataattactttaaatgtaaaagacgtaaactcaccaatcaaaatacacagagcagctgaatgaattaaaacaacagaagaagaagacactgcatacaaatgattcacaatagatttaagtacatataggctgaaagtgaagggatggaaaagatatttcatgcaaatggtaaagaaaacagagcaggagtggccatacatttataagaagaaatagactttaagttaaaaaatggtcacaagagacaaagaaggacattatataatgataaaaggtcagttatctaagaagaaataacattaataattttatatttatatatatttatgcacacacacatataaatacatgtaccacacatacacacacacgtacatataaatacacacacccaacaccagagcacttaaatgtataaagcaaacactgacagaactgaagaaagaaataagttacaatagtaagacatttcattaacccacattcaataaagggtagaacgaccatgcagaagatctagaaggaaacataggacataagcaacactatggagtaaatggacctaacaatatatacacaacattcaccaaacagcagcaggatacattctcctgaagagcacatggaacattctccaggatagatcctaagttaggccacagaaaaagacttaacaaatttaagaagattgaaatcataccaagttttttccgaataaatggaataaaattagaaatcaacagaaggaaggaaaactgggaaattcacacatatatggaaattaaataacagttttgaatagccaatggattaaagcataaatcaaaagggaaattagaaaatatgttgagacatatgaaaataaaaatacaacctaccaaaacctacgggatgcagtaaaagcagtactaagtgggactttcatagcaataaatgacaacattaaaataatagaaaatatctcaaataaacaatctaactctatacctcaaatattataaaaagaagatcaacctaagccaaaaattagtataaggaacaaaatacttaataaagctgaaataaacaaaatggagaatagaaaactgacagaaaaaaattaaattatcacaagagttgtttttcttaaaatattaataaaagtaacttcgagctagacttaaaaaaaaaaaacaggcagaagacacaaaatccaaaatgagagaggaaacattacaaccattgcccagaaatatgaaagaatcataagagactattgtgaacaattatataccaataaatgaataacttggaagaaatagataaattcatagaacatacaagctaccagactgaatcatgagggaatggaaaatgtaaacagataagttagtaagaagattgaatcagaaatcctaaaatttccaataaagaaaatcccaggacaagatggcttcactcctgaattctaccaaacatttaagaattaaagccgatccttctcaaactcttcaaaaaatcggagaaaagcaaacactgcaaatttgtcgttgactccagaacttccctaataccaaagccagatgaagaccctacaagaaaactacagaccaatatccctaatgaatatacatcaaaaaaatcctcatcaaaatactagcaatcagaatttaatcacattaaaatgacgacacatcatgactacacgggattttacgtgggatgcaaggatgagtcaacatatgaaagtcaatgaatatgacaaaccacattaagagtacaaggaataggctgggcacggtggctcacgcctataatcccaacactttgggaggctgaggtgggtggatcatgaggtcaagggttcaagaccagcctggccaacatagtgaaaccctgtctctactacaaatacaaaaaaaagttagccaagcatgtggcaggcacctgtaattccagctactcgggaggctgaggcaggagaatcgcttgaacctgggaggcagaggctgcagtgagcagagattgcgccactgcactccaacctgggcacagtgtgagactctgcctcaacaacaaaaaaagagtacaaagaataaaaatcacatgattatctgaatatatgttgaaaaagcatttgacagaattcaacattgtttcatgataaaacactctcagcaaactagaaataggagaaaattaccttactctaatacaagccatatatgaaaaaacccacaggtaacatcatatacaaaggtgaaaatcggaaagcttttcctctgtctttaagaacaaggcaaaggtacccactctaaccacttctgttcaacataggactgaaaatcctagacagagcaattaagcaagagaaagaaataaaagacatcaaaatcagaaaaaaaaaaaacaagtaaagttgtctgttcttggatgacatgatcttatatatagaaaatgctaaagattctacacacaagaaaactcagaagtaatgaacaaatcccgcaaaattgatagaaacaaaaccaacactgaaaaatcagttgtgtttttgtttgtttggttttttggtttttgtttttttttttagatggagtttcgctcttgttgcccaggctggagtgtaacggcacgatcttggctcactgcaacctccgcctcccaggttcaagcgattctcctgccttagtctcccgagtagctgggactacaggtgtgcaccactatgcccagttaattttgtatttttagtaaaagtggggtttcaccatgttggccaggctagtctcgaactcctgacctcgggtgatccacctgcctcggcatcccaaagtgctgggattacaggcgtgagccaccgtgcctggcctaaacatcaggtgtgtttctatatagtaatgatgactaatcaaaaaaaggaaattgagaaaaatgacctcatgtacattagtatcaaaaacaaaaaatacttaataaatttaagcagggagatgaaagatttgcacactgaaaacaacaaaacactgacgaaagaaattgaagaagacacaaataaatggaaataaattctgtgttcatggatttgaagactgaatattaaaatgttcatactacccaaaacaatgtacaaattcaatgcagtccttattacaatgaatagcattttaaaaagaaataggaaaaaaaagacatatgaaaccacaaagaaccctgaatagacacattttgaaaaagaagaacaaaattagaggcctcatattttatggttccaaacatcataaaactacagttatcaaaacaatatggtaatgatgtaaagatagacccatagatcaatggaacataatagacagcccacaggtatacgttcaactcacgtttgacaagagtgccaagactacagaatgtggaaagaataatccctttccacataagaataaacagtgacaggaattgtggatattcacatgcaaactaacgattttgaactatggtgttgcattgtacacaaatattaaatcaaaatggattaaagaattaaacataagacctgaaattgtagaactcctagtagaaacctagggggaaggtgtcaagccattggtcttggcaatgatttcttgcatgtgatatcaaaatcacaggcaataaaaccaaaaatagacaaataggactacatcaaattaaaaagcttctgcccagcaaaggaaacactcaacagaggaaaggcagtctttggaatgggagaaaatatttgcaaactatatatctgataaggacttaatatgcaaattttataggcaactctttcaactcaatagcaaaaaaaggaagaaaaagaaaaagaaagaaagaaaagaaaagaaaagattaaaaagtgggcaaaggacttgagtagacacttctccaaagaagacataaaaatggtcaccaggtgtaggaaagggtgctcaacaccaggaatcatccaggaaatacaggtcaaagtcacaatgaactatcatctcacaccttttaggatggccattgtaaaacaaaaacaaaattcaactgttggcaaagatgtggagaaactgcagccattacacactgttggtgggaatgtaaaatgatacagctcttatagaaaaacagtacggatatccccaaaaagataaaaagagaactataatgtggtccagcaatggcacatatgggcagtgttccaaaagaatttaaattgggatcttgaagtgatccctgcacttccatgttcattgcagcattattcatagtagtcaagaggtggaaataacttaaatgtctatggaccaataaacggataaagaacacatggtatatacatacaatggaatattatccagccataacaggaagaaaatcttgtcatatgctacaacattcatgaattttgaggaaattatgctaagtgaaataagccagacacagaaatgcaaatactgcatgattccatttatatgaagtacctaaaatagtcaaactcaatgaaggagaaagtagaattgtggttgctatgggccaggggaggggaaatcaggagttgcttttcaaagggtataaagtttcagtcaagcaaaataaaaatgttatagaaatcagctgtgcaatattgtgtttatagttaacaagactgtactgtgtgtataaaaatttgtaaagtgagtagatctcatatgcttaacacaataaaaatatttaaaaaataataggaaataaagcccagtaatagccttactactaaaataagtggtagcatgtgcctgtcatgcgtgcctgtcacatcttcttctaccctaagactttggttagtataaaaaaattcaacttctacagtaacagatctttctctgggaagttcattttagccatttcctcataaatcccaaacaagtattctttctagttcactgacacttcagtgatgatggcaaacagatgaaactcagcacttaaaaaattagatgtgtggaaacacaattaaagtgatagtcattgactacaataataaataatgttaagtatcacaacttcacctaaaacaagtgtgtgttcttgcagatgcctaagaaggtttaacatgagttgctccccaaaataaaaaatttttaaaaaagagtgactccttctcctttctcttgagagagtcttagagttatgacagtgtcgtcagccaccttttcttcctgtttaaatgactggcaaggatcagatgctcactacagaatcgtgttatttttcaaataaaatctaaaactaaaatactgcacttcccttaaaaatgctatacgatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtatcctcttttatttcattgagcagtggtttgtagttctccttgaagaggtccttcacatcccttgtaagttggaatcccaggtattttattctctttgtaccaattgtgaatggagttcactcatgatttgcctctctgtttgtctgttattggtgtataagaatgcttgtgatttttgcacattgattttgtatcctgagactttgctgaagttgcctatcagcttaaggagattttgggctgagacgatggggttttctaaatatacagtcatgtcatctgcaaacagggacaatttgacttccttttttcctaatggaatatcctttatttccttctcctgcctgattgccctggccagaacttccaacactatgttgaataggagtggtgagagagggcatccctgtcttgtgccagttttcaaagggaatgctcccagtttttgcccattcagtatgatattggctgtgggtttgtcatagatagctcctattattttgagatatttcccatccatacctaatttactgagagtttatagcatgaagagttgttgaattttgtcaaaggccttttctatatctattgatgtaatcatgtggtttttgtcgttttctgtttatatgctggattatgtttattgatttgcaaaagagcctgcattgccaagtcaatcctaagccaaaagaacaaagctggtggcatcatgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgacaaaaacaagcaatggggaaaggattccctatttaataaatggtgctgggtaaactggctagccatatgtagaaagctgaaaatggatcccttccttacaccttatacaaaaaattaattcaagatggattaaagacttaaacgttagacctaaaaccataaaaaccctagaagaaaacctaggcaataccattcaggacataggcatgggcaagtacttcatgtctaaaacaccaaaagcaatagcaacaaaagacaaaattgacaaatgggatctaattaaactaaagagcttctgcacagcaaaagaaactaccatcagagtgaacaggcaacctacagaatgggagaaaatttttgcaatctactcatctgacaaagggttaatatccagaatctacaatgaactcaaacaaatttacaagaaaaaaacaaacaaccccatcaacaagtgggggaaggacatgaacagacacttctcaaaagaagacatttatacagccaatagacacatgaaaacatgctaatcatcactggccatcagagaaatgcaaatcaaaaccacaatgagataccatctcacaccagttagaatggcgatcattcaaaagtcaggaaacaacaggtgctggagaggatgtggagaaataggaacacttttacactgttggtgggactgtaaactagttcaaccattgtggaagtcagtgtggcaattcctcagggatctagaactagaaataccatttgacccagccatcccattactgggtatatatccaaaggattataaatcatactgctataaaaacacatgcacatgtatgtttattgaggcactattcacaatagcaaagacttggaaccaacccaaatgtccaacaatgatagactggattaagaaaatgtggcacatatgcaccatggaatactatgcagccataaaatatgatgagttcatgtcctttgtaggaacatggatgaagctggaaaccatcattctcagcaaactatcgcaaggacaaaaaaccaaacaccgcatgttctcactcataggtgggaattgaacaatgaaaacacatagacacaggaagaggaacatcacacactgtggactgttgtggggtggggggaggggggagggatagcatcaggagatatacctaatgttaaatgacgagttaatgggtgcagcacaccaacatggcacatgtatacatacgtaacaaacctgcacgttgtgcacatgtaccctaaaacttaaagtataagaaaaaatgctacatgataggaatgaaaatcggttgatatagggtgatcacaaattactaatttttacttttaccattctgttttcccctcctattgtagtagcattttttgtattacaaatggaaagtagaaggtaataatattcctgaaacaaaacatagtgaaaatcatctgaagaataaacaaaacgaagagaaaaaaataaagacaatgccacaagtagtcgaaattaaacaggagtccttgaaggtgtatatatttttgaagatatttttcataatgtgcttaaacttaattggggaggtagtgtggtgcagaggaaagaatgcacactgcagaatcttgccattttctatctgtcagaccttagacaatccaactaattttcatatcttcacagaataggaatattgtcaaccacaaaataggaatattctcagctaatgtatcagcttgctgtgagaattacagattattttgtgtattggccacctgctgatatatatgtgtctcagaaatacagaattaaaaatgtgtaattgttcagtaaattatagccaatattatggtcacagtcacgatttattgtttgggtgaagagacttttgcccattaacagtctttcctgtcctcactttctacatgttccctaaacctacaaaagaccctttgtttcttcagtagctaaaagctgtcaacatttgaagaaacgtttgtcacttctcttggctctcctattacataacctctctcagtcttggtatgtagctatacgcagtacatccaagtaatcctgactgactttaatactctctcacttgtctgtctttattaactctcaggggaagatgtctggtttgtatggcctaaaatttatacagtttgttctttttaaaaaaagaaatataaaattttgaatacaaaattacatggagaatgtttctttatactgtgaaaggtgatcacaacaaatttgaaaaaactgacatataccttcaaaaaacagtcccaaaaaacatttttattaatgactgctcaaaacaccgttctccctacaattttggctgcatatttctgatcctcttttaatatgacagagattgttattctgtctagagataatgaggactaattctttctattagcatagtgtgttttgttaataaatggtataaacaggttttgtcaggtttacaactcatactgatagtgttatttaatgtttaggttttttttttaatttgaggaacctcttttatatgaattgtaagaattcagtgtactttaagttttcttcttccaaaggtaatcctaaatattattgcaaataatgatgctcattagccaatttgctgtcaataactcatttcggtggcataatgttctatgttatctttgttgatgtcaacattcctaattaaactggcaagaaatttaattacatttcaatacagttcatataactcactcctcttcattaattgactcatcagacaaatacaagagcctgttcattacttctaatagaactttatctcttcctgttattactattttgatttatgatctaaattttaattactttgttatattgtcttgtttcattatttcttgatgtcataattatttctattaatcccattgacctttattattttcatttcatcttgcattcgacaattgtttgatttttctctaacatgttttgttttaaagatggataaaacaagagaagataaaattcatgtatttcaaatcaggaacctattgtttatccttgttttattaagacttttcaaaataaaactctttcaaattgcagataaaatgacatacacccagatctactactcgttagctatatcttcaacatgtgcatagtcctccaatataattggaagtaggtatgtgtgccggaggattcatgatagaaagagatagttgtcttaacagggtgtcatgatgtattgtttttgtgtcttttacaaaattatatgagcacaaaaacattttgctaggaactcttccagttttcaacgtttaagcttgattccttagtttcagggtaaatttgtctctatcattaagactttaaaggtgcccctatatcttacatcctaagataatgtgccttttctgttgtgcaaacttttaaagccttctttcagtccttttcgtcatagccaaactttcctagacaatagttttctaattcattacaatgtcttctgatcctgattctacatattaaacatatgaattttaacaaaaatctcttccttagaaaatacaatatactctttttcttttcatgttctataatgatgttttagcattttctctttagttggtgttactggactgaatatttgtgttccccaaaatttagatgttgaaatcctaattgctaagctgatggtattaggtcgtgggacctttgagaggtgattaggtcatgaggatagaacccacatgaatgagattagttctcttataaaacagaccctcccctgcccccagagccctctttctttttcccatcaccatgtgaagatagaagaagttggcagtctgcaacacggatgagagccatcactcaaacttgaccatgctggcattgtaatcttggatttctagcactctcaccttggatgtccagcgataaataagtgtttgcatttaagtcactgaatctatggtaattttttacagcaaccaaactgaataacacagtggtcattttcttcttaaaattctgtcttccttttgctttctttacttccctattttccttctggtcatttcttcttggttacatttatggacttttcttctgctgcttttcttaaatgtatctctcaagtcttttttttccttggtcttgtcttttcctcactcaaagatctctccccatccacacttattgctttaagtactgttatttttggagaaatccctgaattatacttctaacccgtactattagctccagccaatttcccatcaggtattcaaaactcagaaaatccccagatgaattattctcttaatagcttcttccttattttgtgtcacagtgaactacattatcatttaaaaatgtgttccaatatggaaataactttgtattatttccttcagccatcatttttggggtaaggggtccataaaaacatctctattcaaaggcataaagatccttctctcctggtcaattgaaaaagaaatatgtttgagaatttatattgggactaatttcttcttatttatgtgaattaactttcactatcatacactgagtgaaatcaaaattttcaacaaaaatcagaggaatagttttaagcaaaaggatactttctaaaataacgcataagttccctatcagctatatccagcactgagctgacagtcataggccttcttgaaatgcacctgatctatcatggctgcaataatcacaggccttgcataaatcctctaagaggagccaggaaatgaataagatgtccatgctctatttatagcatacaaaggtcaagtttctagcttcactgtttatttatccagtttcttactggctgccacagatcttcagctgggaactcacagaggacagtagccatggtcggtactcaatcggaaaaattaactggagttcaggtaatgtggaatgttttgataggttgcacatgcagctactttagtatttgacataagcaggttataagattataaggccatgctgagaaacatatcacccaggaaataattaattcttgtatttgaatatgttctaagataccttcctatcaccttatgtttataatgaggtctatttccttaacatacttactgaaacacagggcaagatggatttgtcatcttgccaattccgggtgaaaaatgtcaagactgtgtgtgtgtgagtgtgtgtgtaggagtgtgcatttgtggaagggaatgtgtcgagggagaaaaggaagaagggagagagaggaaaaggcagtatctggggggcgggggaggtggccaggatggccgactagaagtagctagtgtgtgcagctctcagagaatggatgggatgagtatataaccttcaactgaaacattcagatacatgcattggaactaactggagaatcaaatctctgttctcgactcatggagaacagagaaaagcaaggcaggatgacagcccacccaggcacaacatggagccaggggaacctctccaacccagggatgtggtgagtgaatgagtgactccaggaaatcatgcttcttccatggatctttgcaacccttggatcaggagatcccctcataaacccactccagcagggcagtcaggcagacacacagagctatgtgcaaccttggcagagcagccactcaggcacatgcaaagacccaggagccttagctatccaggctttccaggcttcctggcaaaggtagctgcaactccaacaaaaagggaggttagatccctgtacataactctaggaaaggggctgaatccaggggctgagtggcaacagttggcaggtcccatttccacagcacctgataagacccactggcttggaattccagccagccagtggtagcagcagtgcacctccctaagacagagctcccaaggggagtggcaggctgtcatctttgctattttggtgacttagccattccagcctttgggttttggagagtccaagatgaccagggacagaaatggtccctcagaacagcatagctgctctaccaaaatgtggccaaactgcttttccaagtgggtctctgatcccattcttccttaccgggcaagacctcccaaacagggtctccagtcaccctcaccagtgctctctagctgacagatttcaaacatcccggcctcagagatgccagagggtggagcaggcctccctgcttttttaagtgggtctctgatcccattcttccttactgggcaagacttcccaaacagggtctccagccacccccaccagtgctctccagctgacagagatttcaaacatccctgcggcagagatcccagagggtggagcaggccaccatctttgctatttgggtgaattagctgttctggcctttgggctttggaatgtccaaggcgaccaggggctgaagtagaaccacagtacagcacagcttctctatgaaaatgtggctagactgttttttaaagctggcccccatctcattcctcctcactgtgtgggacctcccagatcgggtctctagccacttcctacaagtgctttcaggcagcaacatgtccgtatctccctgggatgaagctctcagagggaggggtaggctgccatctttgctgttttgtagccttcacagttgatacctccaggtactggaaaatccgaggtgactagggactggagtgagcctgcagcgtaccacagcacccctacggaaaactggccagattgttacgtgagtgcccattcccatatctcctcaccatgcaggtcctccaggccttggcctccagcaaccccctgccagagctattaagccaggagcagctctgcaacttcctggacacagcccccaggggcaactgaaagcctctctgccactgcctctacagtggaactgcccttgctactctcagactaatgaaggagcaaagaccctaagtgccttaaacaaatctccagcaagatgcaggcaacagagaggaggtcagtctgtctcccataggtcccagatactccccactgctcataatgagacagaaaagcctcagcttgggcccacagcacagacacttcatcctgggctgattgtacagattgctgacctacatctctctggggtggagcctccagcagataagcaaaagacccttcggcacaagttcccttcttctctgcctccaggttggggtaggaacgtgaacactgagatcatcccagagttgcaatgggcagcacaggggtgccacgctaagatctacagccagcactcaaaggggagaggaacccacactctcagagcattgagagggaacacagctgtaactgtgaggaaacacagggaagccacccaactgagcaagagtctaccaactgagcaatatgtctaagtgtccaaagcttcagccctcaaaataccttgctaacataccccctctgaaaccaaagacaagaagtcagcttcaaataaagaccattcacaaaggcttggcctggtgaaaacatccagaaaacaagtctattgactgcattcaatctatactacagtaaaaggaacacccacatgcagagatcagagagaatcaacccaagaactccggtaactcagatggctagagtgtcgtatgtcttccaaacagctgcatgagctctccaacaagagttcttaatcaggctaaattggctgaaatgatagaaatggaattcagaatatggatagaaatgaagatcactgagattcaggagaatggcaaaacccaaaccaaggaaactaagaatcagaataaaataataaaagagctgaagtacacaatagcaggtataaaaaagatcccgatggatctgacagagctgaatcacacaaaacaagaatttcacaatgcaattacaagatttaacagcagaataaaccatgctgagaaaaggatctcagaacttggaagactggctctctgaaataagacagtaagaaaaaatttaaaaaagaaaagaagaaaacctctgagaagtaggggattatgtgaagaggccaaatgtatgaatcattgacatccctgaaagggtgagcaaacaacttggaaaatatatttcaggatattttccatgaaaatttttccaaccttcttagagaggctaagagtcaaactcaggaaatatagagaacccctgcaagattctacacgataaaatcaaccccgagacagataatcatcagattttccacggttgaaatgaaagaatattaaaggagctggagagaaagggcaggtcacttacaaagggaaccccatcagccaaaaaacagatgtctcagctgaaaccctaaaagccagaaaagattgggggcctatattcaacattcttaaagaaaaaatatcttctaccaagaatttcacatccagacaatctaagcttcctaagcaaaaaagaaataatatacttttcagataaggtaatgatgagggaattcattaccaccaaacctgctttacaaagagactttaaaagaagcactaaatataggaaaaaaaagattgctaccaactaatacaaaaacactcttaaatacacagaccagttacactataaagcaaccacaccaacaagccagaataataaccagctaacaacacaattacgggatcaaatccacacatattgacacgaattttgaatgtaaatgggataaatgatccattaaaaagcacagagtggcactatctcattccagtcagaatggtcattattaaaaagtcagaaaataacagatggtggtgaggttgcagagaaaagggagcagttatacactgttggtgggagtctaaattacctcggccattatgaaaaacagtatggtgattcctcaaagggctaaaagcagaactaccattcaaccaagcaatcccattactgggtatatagccagaggaatataaatcattctaccataaagacacatgcatgcgaatgttcattgcagcactattcacaatagcaaagacatgaaatcaacctagatgccatcaatgatagactgaataaagaaaatctggtacatatacaccatggaatattatgcagccatgaaaggaagtagatcatgtcttttgtgggaacataaacggagctggaggctattatctttagtaaaatcgggcaggaacagaaaaccaaatatcacaaatttttcatgtataagtggaagctaaatgatgaggactcatgaacacaaagaagggaacaacagacactgggttctagttgagggtggagggtgggaggagggagtagagcataaaagaaaactattgggtactgagtttcatacctgggtgatgaaatatctgtacaacaaacccccatgacacaagtttacctatataacaaaccttcacatgtaccattgaacctaaactaaaagtcaaaaaaaaaaaaaaaagaaaacatttgtgtcagtgccagaaataaagacactgaaaatgtgcacaaaagaaaaagacagtaaaaaattagaaataattttaaactggctttctagtattaccatattattcaacactgcaaccatctctaacacttccaaatcttttttccacaccatcctcttttctacagcatatgtacctgttttagttgagtcttccaccattatatagccttgaatgttaaaaaaaaaaatcaaatactaaatgtccctgctttggcttttctacttatcacatgaatctataacatacccatgaggttgacttttcaaaatacaaatgtgtttatattgcttcacttttaaaatgatccactctatccccaataacttaaacataaaaattaaaagtcaatattccctcaaatgaagacatacaaatggccaacaagtatatggaaaaatatttaacattgctagtcatcacagaaatgcaaatcaaaaccacaatgaaatattttctcaccccagttaggatagctagtatcaaaaagaccaaaaacaacaaatgctgacaaggatgcagagaaaacggagctcttatgtagtgttgttgggaatgcaaagtagtatagcctctaaggaaaacagtacagaggttcctcagaaaactaaaatagaactaccatatgatccagcaatcccactactaggcatgtatccaaaggagaggaaatcagtacataaaagtgatatctgcacctccatgtttattgcagcactaatcgcaatagacaagatatgaaataaacccagctgtccaaaaacagataggtggataaaaaaaaatatggtatatatactcaatggagaactatttatgcataaaaggaatgacatcctgtcatttgcagcaacgtgaatggaactgacctacatcaagtgaataagccaggaacagaaagtaaaacactgcatgttttcactcatacacagaagtttttaaaaaaagtttatcttatataagtaaaagtggaatagaggttactagaagcttggaagggaagggagaagagaggaatagagagagcactggtaaaggaaataaaatttctgctagaaaaaagcagtaagttctagagtttcatagcaccataggataactatagtaaatattaatgtgtattttcaaatagctaagagagaggacagtaaacattcccaacacaaaaaaaaataaatgtttggaataatcatgaatatgcaaattatcctgatctgatcactatacattgtatgtgttaaaatgtcactatgtatccccaaaatatgtacaatcattatgtgcccatttaaatcatcaatatcaattcacgttttgacccttacatgggcctcaattaatagactgcatgtgagatgattgagggtagagaacataaatatctgtgagtgtgataaaatacttgttttacttggggacagatgtgaaagtagaataataaaattgttaggaaaatataaatatgtgtgtagataatttctttataattcagatgtaagtatttgaacaatacactaggttattatgcttctactggtatgagatatttagtctgtacaatgtacagcaggatataagcaaaaattaaacaagaaatatggcatttcaaaaagtaagaggaatggcagagacacattggaaagataaatcttcagtccaatatctgatgaacatagacacaaaaatccctaacaaaatacgggcaaaccaaatccagaagcacaacaaaaaattaattcaccacagtcaagaaggcttcactcttggaatgcaagattggaccaacacacacaaatcaataaatgtggttcaccataaaaacagaagtaaaatccaaaacaatatgattatctcaatagatatagaaaataccttcgataaaatttggtatcactttatgtcatcaaaggaacatatctcaaaataataagatccacctatggcaaacccacagccattatactaaatcggcaaatgctggaggaataccccttgagaaccagaacaagacaaggatgcccactctcaccactcctattcaatacagtgttggaagtcttagccagaacaatcaggcaagagaaaaaaagcgaatccaaatagaaagagaggaattagaattatctctcttcacagatgatatgattctaaacctggaaaaccctgaatattccacgaaaactactagaactgataacttctgtaaagtttcaggatgcagaatcaatgaacagaaatcagtagcatttctgtacaccaataatgtataagctgggggccaaatcaagagagcaatcctatttacaatagccacaaaaagaataaaatacctaggaatacagctcatcaagaaagtgaaagatatctgcaaggagaattacaaaatactgttaaaggaaatcagagttgatacatacaaatggaaaaacattccacacaaggataacaataatcaatatggttaaaatggccatacttcccaaagcaattcacagaatcaatgctctatcaaactactaatgtcatttccacagaattatgaaacactattctaaagttcatgtagaatcaaaaaaagagcccaaataaccacagcaatcccaagcaaaaagaacaaagttggagacatcatgttacccaacttcataccctactacaaggctacagtaaacaaaacagcataatacatgtacaaaaccagaagcatagaccaatggaacagtttagggaacccaaaaataaagccgcatacctacaaccatttgatctttgacaaagtcaacaataataagcaatagagaaaggacttcctgttcaacaaatgatgctggggtaactcgctagccatatgcagaagatcgtatctggacccccttccttgcatcatatacaaaaattgactcaagatgcgttaaagacttcaatgtaagaactaaaagtataataatcctaaaagaaaaccaaggaaacaccattttggacatcagccttaggaaagaatttatgaccaagtcttcaaaagcaactgcaacaaaagcagaaatttacaagggagatctaattaaactaaagagcttctgcacagcaaaacaatcaacagaataaacagacaacgtagaaaattagacaaaatagtcacaaaccgtgtatctgacaaaagtatgacatccaaaatctacaaagacctcaacaattcaacttgcaaaaaaagggcagagcgtcatggcagaatggaaggctccatgctgatctccccaaaaaggatgccaatttaacaactatctacataaaagaaaagcaccttcataagaaccaaaaatcaggtgagcacgtacagtacctgattataacttcacatctctgagaaaggcactgaagggtagaaaaagcagtcttgaattgttgacaccaccctttttccccttcccccggcattggcagcatggtgcacacggcatttttgtgtgatggatagagggagagtgcagcaattctggggcattgaactcagtgttgccctgttatggcagaaagaaaaactggtctacactcagctgacacccacccacagagggagtatttaaaacagccatagccagaggtgaagtgctgatcccagcagtcagaacttgagttctcacaagcctcaccactgtgtgataatgaactctggggtcctaaataaacttgaaaggcagcccagggcacaaggactgcaactcctaggtgagtcctagtggtgaacttgacccagagcctgtggacttgggtaggggagtggcacacaacttactaagacaccagctggtgtggctagagagtgctggcgtgatagcccacggcttcaaaggagacctcttctttctgcttgaggagaagagacggaagagtggggatgaccttgtcttgcatcatggataccagctcagccacaggaggatagggcaccagtcagagttgtaaagcctctatttcaggacctagctcccagatgacatttctggacacaccctgggccagaaggaattctgctgccttgaggatccagtcctggcagaatttgtcacctgttaactgaatagcccttgggtccagaataacctgctgtgatacccatgcactatgttaagggccttgtgtgagactcagatttgctggcttcaggtgagactcagcacattctaagctgtggtggatacagagagtgacaccttctgcttgagaaaagcagaggaaaaagtaaagaccttttcttgtaccttacgtaccaggttggccacaggggtatagagaaccaagcaggctcttggattccccaattctagaacttggctcttggacggcatttctggacctgccctgagacagaggggaggtcattgccctgaaaggtgtgtcccaggccaggcaatattcaccacaaactgactgcagagcctgaagaaaacattggcagtagtctggcagtactccctgtgggcctctagtggcagtgtccatggtgtgaggctcctctgcctttggaaaggagaggaaagagtgaaaaggaccgcatcttgtggtttgaatgccagttcagccacagtacaatagaacaccggatagagttagtaggttttcgactctagcccttggctcctggacagcacctctggatccacctggggcctgatggaactcactgctcttatgggaatgacataggcctggctgtctttgccatctgctgattgtagagcccaagggccttgagagaacataggtggtagccagggagtggttgcagaaggccttgggtgagacccagggctgtgctggcctccagtctgacccagagcagtccttgtggtggtggctagaggggtacttgtgtcactctacccctcctgctccagatagctcagaatggagagacactgtttgtttggaaggaagtaagggaagtgaacaagagtttccgcctggtaatccagagaaggcagccacttcccagagctccactagggagttccccagtggggactctaagtgtgggcatcgactccacatttccccttgcactgccctactatagtctctctgtgggagctctgccactatggcaggcttctgcctgggcacccaggcttcctgatacagcctgtaaaatctgggaggaagttgccaagtgtccttcactctggcaatctgtgtgcctgcagacttcacaccacatggaaactgccaaggtttacagcttgtgccctacaaagtggtagcctgagctgtacctggggccctttgagccacggttggagctagagtgggctgaatgtgggaaacagtttcctgaggctccacaaggaagcaaacctgctctgccccctaccttttctccattgttttagatattagcacttggctcccttttagtcacacaaatctcactagcaagtggttgctctgcatcctgcttgcattcttctgaaaacgctctaaaaaaaaaaaaaaaaaaaaaaaaaaaaaaaagataaccaggctgtgaattttctgcttctcttttaattgtaagttccaaatttaagtcatttctttgttcccgtatctgatagggttttagaagcagctattccacatcttaagtgctttgctgcttagaagttactttgactagatactctagttcatcattcttaagttcaactttccatagatccctaggacatggacacaatgcagccaagttatttgctagggtgtaacacaggtaaaatttactccagtttccaataatttccctatttccatctgaggaaatggaagcctggccttctatcaacattttggtgagaactacttaacaagtctgtaagaagtttcaaacttgcctcatcttcctgcattcttctgagccctccaaattcttccaacctctgtttattacccacttaaaaagacacttccacattttcagttatctttatagcaatgccctactgattggtacaaattttctgtgttaatccattagcattactgtaaaggaatacaggagattcattaatttataaagaaaagaggtttatttggctcacggttctgtaggctgtacattaagcaaagtgctgcatgtgcttctggtgtggtccttgtgaagcttacaatcatggtggaaagaaaagggaagcaggtgtgccacatggtgtgagagggagcaagacagagatgggaatgttccaggctcttttaagcaaccagatctcaactatcagaacaagaactcactcattaccgtggaaagggcaagaaaccattaatgaggcatctgccctcatgacccaaccacctcccaccagacccacttccaatattggagttcacatttcaacatgagatttggaggggacaaaatacccaaaccatatcagcaaattagttgagtcactgtggaaagcagtttggacatttctcaaagaacttaaaacagaattatcattcacccagcaatcccattactgggtatatacccagaggaatataaatcattctatcataaagacacatgcacatgtatgttcatgatagcactgttcacaacagtagcaacatggatcaacctacatgcccatcaatggtacactggataaagaaaatgtggtacatatacatcatagagtactatgcagccattataaagaattaaatgatgacctttgcagcaacatagatacagctggagattgttattctaagtgaattaatgtaggaacagaaaactaaatactgaatgtttttacttacaagtgggggataaacattaaatacacatggacagaaaaatgagaacaatacacactgggactgttccagcagaaagattagaggcgggcatgggttggaaggctagcttacaggtactatgctcactacctggatgatagtatcattcatacaccaagcctcagttacatgcaattcacccaagtaacaaacctgtacatgtacccctggaacctaagataaaagaaaaaaaaatggtaaacaaaaaatcataataattttgtttcaaaaacacaaatacacagattaatatctaaatactaaataaaatattacaggcttgctttcacagaagaaaaattggtacatatacatcgtggaatacaatgcagctatagagaatgaaatcatgttctttgcagcatcatggatgcagctgaaggccatcatcctatgtgaattaatgaggaacagaaaaccaaatactgcctgttctcacttataagtggaaagttaatgctgagtacacacagacacaaagatgtgaacaacaaacattggagactactagagatgggaggatgggatgggggcaaggattgaaagcctatcaggtactatacctggtacctgggtgatgggatcattcatccccaaacctcagcatcacacaatatagccatgtaatatacctgtacatgtaccctcgaatctaaaataaaattttaaaaaaataacaaataatgagggtacaaggacacatagatgaaaacaatagacatttgagactacttggggggagaattagaggggggaaagggtttaagtacgatcaggtagtatgctcaatacctgagtgacaggatcattcatgtatcaaactccagagacatgaaatttacccatgtaagaaacctgcacatgtacccccttaacctaaaacaaattttttaaaaaagggaatgaagttgtaatttaacacaaggaaaactgacgattcatttcatttggctagtatacaaccttgacttcaaggtacttttaaggatagtaaaataaaattgtaggcttactttacctattaacatagaaataagttatacaaatctgatgattacatttaagagacatattttcaagtagagtgatttgcttttatcaggagtacatcagaaaaggagaaatatcaaagctgtcttaatataattattacagtaatttgaatcaaggagaatacgaatttcagaaataattatgtaccaaaaacctacagcaagcatttaatggacaaacttgagatatattctttttaaatcagaaacaaggcaagcatgatttatatcatcgttatcgtttaacaaagtatttgtatacctgaccattactataggacaacaaaaaggggaaacatgaaacctaagaattagacggtagaaatctgagtttggtacatgttatgatgatctacattaaaaaaagaaagaaagaacagacaaggcattagaactaataagagagcacagtgaagctactaaatatttaatctaaccaaaccaattaataattttattccatgctagtaaaaccaaacgtaaaacataagagcaaattgagtgctatttacaaaagcaacagaatttgtgcagagcccattatttaacttaaagaatgcacactaagatacaggtaagggaataggtaaaaggctaacgaaacaagtaagctcagaggggaatctgggcaaaatatataaaggaccctctgtggtattttgcaacatctcatgaatatgtaaatattttaaatataaattttttaaaaagcttaaagacagacccacgtatttaaggtgagttgatgtattataaaagtgatacaaaaaataaattgacaaaaagactgcttagttgattttgtggggaatattgatcactaattggcaaacaataaaaatgatttctgatttaaaagaagatgtaattacagatgccaaataaacaaaagagaaaaatataaaagacaatgctattttgcatcaatattcatcaggaatattggcctgcagttttctgttttttgatatgtttttgtctggttttggtatcagggtaatactggcctcagagaatgagtttgaaaatatcccctcctcctctgtttttctgaatattttgtgtagggttggtattagttcttctttaaatgtttgctaaaatttagcattgaagatattgggtcctttgcttgtttttgctgggatacttcttatgacttcaatctcattacttgttattgtctattcaggttttggattacttcatggatcgatctttgtaggttgtatgagtctaggaatttacctgtttcttctaggttttctaatgtattggcatatggtcgctcatagtagtctcaaatgaccctttgaattcctgtggtttcagttttaatgtctcctttttcatctctgattttatttatttgggtctcttctatttttctcaggttaaatcttttgtttactttaaaaaaacaatgtgttttgttgatcttttatattttttctttcaaatttattaatttctgctctgatctttatttcttttattctattaattttgagtttgttttgctcttgcttttctagtacttttaggtgcatcattagtttctttgaagtttttctacttctcttatgtaggcaaacatttatataaaccaccttagtagtgcttttgttgtatcccataggtttttgcatgctgtgtttccattttcatttgtttcaaggaaattttaaattttgtacttactttgttcatcgacccactggtccttcatacttttaaactttttgttttctatttatatcttattgcacgatgtctggaaaagttgtatagttattatttttgatagtttcatcttttagtatttattctcacgatacgagttcatatgacacagttgcagtattataatattctatgtttgtctctgtagttattattaccactgagttttgtactcactggtaatatttcttattgtttgttaacattcttttcttttagattgaaagactccctttagcctttcttgtaggacaagactggtgttgataaaatccctcagcttttgtttttctgagaaagtctttatttctacttcacgtgtgaagtctattttcactgaatatactattctaggattttgtttttcctttagcactttaaatatgtcatgccactctcttctggcctgtaaggtttccactgacaagtctgctgccagatgtactagagctctattttatgttatttcttttttcttgctacttttaggacactttctttatctttgacttttgggagtttgaatattaaatgccttgaggtaatcttcttttgggttaaatctgcttggtgttctataactttcttatacttgaatgttgatatctttctccaggtttgaaagttctctgatatccttttatataaactttctacccctatctctttctctacctcctccttaaggccaatgactcttagatttgcactttcgaggctattttctagatattgtaggtgtgcttcattaattcttttttcctttgtctgctctcactgtgtattttgaaatagcctgtttcccaactcactaattcttttgtctgcttgatctactctgctgttgagatactctaatggagtcttcagtatgttaaagtttcagctccagaatttctgcttaattttttaaaaaatatttcaatttctttgttaaatttatctgatagaattctgaatttcctatcaaatgtatgggtttttgtttgtttgtttttagatggaatcttgctctgttgcccaggctggagtgcagtggtgcaatctcagctcactgcaacctctgcctcctgggttcaagtgattctcctatctcagcctcctgagtaactgggattacaggcatgcaccaccacacccggctttttttttttgtacttttagtagagatgggatttcaccaagttggccaggctggtcttgaactcctgacctcaagtgatcctcctgccttggcgtcccaaagtgctgggattacaggcatgaaccaccatgcctggcctcttgtgttatcttcaatttcattgagcttcctcaaaatagctattttcaattttctgcctgaaaggtgacatacctctgtctctacaggattggtctctggttccttatttacttcatttggtgaggccgtgctttcctggattgtcttgatgcttgtggatatttgtagacatctggtcattgacaaattagatatttgttgttgacttcacaacaggggtttatttgtacccatccttcttggatggctttccatgtactcaaaggaaattcagtgtttttatctaagtctttggtcaccgcagtcatatcttattagggggcacctcaagcccagtgatgctatgactcttgcagacttgtagaggtaccaccttggtggtcttgactgagatccaggataattctctggaatgtcaagcagataaactttttctcttccattactttttccaaaacaaatggagtatctctttgtgctgtctggggctggggtgggggtggtgacatagcacccctgtgaccaccaccactgggactgcatgggtcagacctgaagccagcatagcactgtttcatccaagggccatggtgacagctgcctgtctaccgctggtgttcactcaaggcccaggggctcttttgtcagcaggtggcaaatccagccaggctggtgtcctctccttcagggaggtcagatcctcactgaccccagagtagatcagtgctatctgggagcctaggcttggagttgggaaccttaggtatctccttggttctctattctactatagctgaactggtactcaagccacaagacaaagtcattcccactattctctcttccttcctgatgcaggaatctctcccagtggccaaactgccccaggcctgtggtgaatactgcctggttaccagtgatgttcactaaaggcccaaaggctcttcagtcaccttgtggtgtatgctgccaggccttggtctcttccttcaggacagttgcctcccctctggcccactgtcaatatatgccatccagaagccaaggcctggaatcagggacctcagaaacccacgtgatgctctacttcactgtgtggctgagctggtgcccaggcagtaaaacaaaatcctctttattctttcctctcctttcctcaagcagaaggagtttttccccatggccaccagagctggaatgtgctgggtcacacatgaaaccagcacaggcctgcatctgacccaaggtctgtagcaagtacaacctgggtactgctgatgcttatttatggcacaagggatccttaattgaaggtgataaatcctatcaggacttggtccttctattcaaggaaggtggttaatttctgatccttgatatgtctagaattgttgtctaagagctagggcctggaatgtgggcctcaggactctggctggtgccacattctactgtggctgagctggtatccaaggtacaagacaaagccctctttttcttttttttttgtaatgaactcacattttatttaacttcttgctcatttttaatcccaaataagtttagggaattcctatttatttatttttctttttttttctttttttaaatattttttttcattatactttaagttctagggtacatgtgcacaacgtggtgggactgtaaactagttcaaccactgtggaagacagtgtggcgattcctcagggatttagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtgccaaagcccccttcactcttccttcttctagtcttgagtggaaggaaggagtctctcctgaagctgtgagctgcattgccgaaggttgggggaggggtgacacaagcactcccttggtctccccagcttgtgtctcactaggtcacatgcaccccaagtccactggctctgagcccagcacagcaagagaactgggctaggaattgtagtccttgtaccctagattacctttcaagtttatttaggaccccagcatgcttcagcccatggtggtgtggctagctgtaattcaagctccaaccactaggatagaggattcccttacagctatgacagaattgaattctacccatgctccctgggcacctgcagaattcaattctgtgtaacttttctctgtgacagggcagcactgggttataatgaaaagtcccacaatcattgtgctctctttcccctaagcacacagattctctctcctctcttagtggccagtgtcaggggctgggggaagggtggtgttggcaatttaagactttttcttttactcttttcagtgcctctttccttgatgtaatgttaaaactaggtactctgattactcacttggttttggggttttatgaaggtgctttcttgtgtgggtggttgtttaatcttgtgttccagcagggggaacaattactggagggttccttttggccatcttgctccacctcttccaggttgaatatgtttctttttctttaatgccatgtgattaaatagcgatgatagagagacagatgatgatgtgtgaaagagctgaaattctcatctacgattataggaaatcaatgaacaatgtgaaaaataatgaacccaagctatcatactttcttcttttaagaatgtagaggtaactatctgtataaagagttaatgaaaacatcagtgattgcctctagggagtaaaatgtggggtgggggcggttaaagggaagaaaaagccaagcatttataacaataaaaataaacgctttttagcatgatttaatactataaactaaaaataagtaagtataatttattgtgcacattgtttcagaaaatattttaagcattttacatgtgtaatctaatttaatactcacagaaaagcaatgagttacgtattatttgttacctccatttcacagacgaataaattaaatcatatagaagttgttactgcctaaagtcacacggtgttggttagtggtggtgtcagtgtttattagatcataaaagcataagtggtcagactccagaaactttattaagtgtcattccatgctttgataaaaacatagaatattttatattttttaattcatttacttatttaattaacttctttatttatgagacagagtcttgctccattccacaggctggagtgtagtggtgcaatcatagctcactgcagcctcaaactcctgggctgaaatgattctcccatcacagcctcctgagtagctaggtctacaggtttgtgccaccatgcctagctatcatgatatatattttgaagaggagccacatcaggagaaagatggggcaatagtcacagtgggaattaagaaaatatttgctttttttgtccttgagttttttgtgtggttatgggagtaatttgggatgggagagtgatgagagaaagaaacagttagagactcagatcaattgaaccatacaaatggtaaaggagtatgtacacatcactgagaggagataagcaaggtagatgtgcctccgagtggtgagaaactcaaactaaaaacagaggttatgtataggtgttccatctgacaatcacagctgagtttccagctgacaaatggcaccaactaactatcagccatgtaagtaaataatcttggacatccagcttagtctagccttcatatgtttcctgtcccagcaacagttctttttttaaaaaaaatttctcttattttattagtttcaaattgctaaatggattttccaaccacctcagatcccttaatgtttgcaaatggactagaaatgggagtggaagaagagaagcctgccaggtttcagagtctaatccagtttcacaattcacttataatctgatacccatctatctctttttggcactcaaaagcccaggtctttcctggaagcagcaaggcacctcattacctacgagggaccacacatagatctgctaagctaggtgttgagaaccactgaatcagaaataaaaaaagaatttgggccaaaagcagtcagcacccacagggaacacaggcacagctcatacatgagcagccagaatatgacagccatgaagaatccaatattagaggcaaatgacccagttacatcatcttatatggcatttcttctgttattccatttaaaaatgagatataatttataaacccctatttagagtatataatgtatttgtattatattcacagaatcctgccacaatcactacaatctaatttgagaatacactcatcactccctaagaaatcttatacacactagcaatcactccccattcctccctccatgctaagcttcagaaaaccactaatctactttctatctctataaatttacatattgtggacatttcctagaaaaggaataacactatatgaggtcttttgtgatttacttctgttactcaacattttcaacgttcatttatgttgtagcatgtatcaatactacatttattttgatggctgaataatattccaatgtatgaatataccaaattttgtttactccttcatcagttgattgacatctggattgtttccattatttggctactgtgaatattttgccatgaatgtctgtgtaagtttaggtttaaacacttgtttttaattatttttgctgtatcacttggagtggaatggtacctttaacattttggggaactgccaaactgttttccaaagcagatgaactattttatgtttccacaaacaatgtatacgtgttcagatttctcttcattttcaccaacacttgtccttacatgtctttttcatcatagccatccaagggggtatgaagttgcatttaatggtttccaatgaattctctacttaaaaatgatgttacagatcatttcatgcacttactggccatttgtatacctgttttagagaaatatctattcatatatgttgtcatttttaattatttgttcttttaatatagagttgtaaaattttttacagggtctagatacaaatcctctatctgatatataatttgcatttttcccattcggtgggttgtcatttgactttcttcattgtgattttttttaaacatagaagttttaaaatttgatgaagattaattaagctattctctcttctgttttgcttttggtgtcattctctaaaacaaggtcatggacatttacacttattttctcttaaaagttttttctttctttctttttttttagacggagtctcgctctgtcgtcaggctgtagagtgcagtggcgcgatctcagctcactgccacctctgcctcccaggttcaagcaattctcctgcttcagcctcccaagtagctgggactgcaggagcgcgccaccacgcccagctaatttttttttttttttttttttttttttagtagagacagagtttcaccatgttggctaggatggtctccatctcttgacatgatccgcccgcctcggcatgccaaactgctgggattacaggcatgagccaccgtgcccggccaagagttttatagttttagttcttatatttcagtccctgattcttttagagttaatttttgcatatgaggtgaggcaagtatgcaaattcactaatttgcctgtgaatatacaattgtcccagcagcattaattaaaacaaagttcatttctactttaattgtcttgttcccttatcaagttccattggccaaaatgtgaggacttatttctggactctcaattcaattccagtggcatatatgcctacatgtacaccactgccactctcccttgattataatagcattgtaataagatgttaaattggaatctatgagtccttcaacttgtttttctttttaaaagattagtttaactactttggatcccatgtgattccacattaattttaggatgaacagttcaatttttgcaaaaaattgaggttagcatttttgataggggttgcattgattgctgtagatcaattgttgtgtaccattttggcaaatattgccattctaataatatcaagtctgccaattcaagaagatggtatgtctttttttaatttagatcaagcttgcccaacccttggcccagggtcacatgcagcccaggatggctttgaatgtgacccaacacaagcacctaaactttcttaaaacattatgagattgtttttcctatttcttttttttagctcatcagttatcattagtgttagtgtatattatgtgtgacccaagacaattcttcttcctccaatgtggctcagggaagccaaaagattggacactcttgatttagatcttccatagtttctttcagcaatgtcttgtaatatttactgtacaaatcttatactattatggttaaatttattcctaaatatttcatcatttttgaggataatgtaaaccaaaccatttttaatctcattttcactttttttactgctagtgcttagaaataaaatttatttttatacattgatcttgtaacctataactttgaagaagttatttattagttctaacaggtttttagtggattctttaggattttctatatataatataatgtcttctgcaaatagagttttacttcttctttttcaaacttgatgctttttattgttttcttgccaaatcacccttgctaggatgtttagtacaatgttaaataaatgttttaggagtgatgtccactcacgtcattttttgtcctctattctattgatatggtgtattacattgattgactattgaatttttaaccatacttgcattcctgaaatctgggataaatcctccttgtatatgtatatatgtgtgtatgtatatataaaacatgtaatatatggatataaatatacatatatgcatacacatacacacacattaaagcatgtctatatgtctttgctttcttttctatacattggattagttttgtagtatttagttgtttagaatatttgaatctatattcgtaaggcatatgacctataactttttctttagtgatgttcttgtttgcttttggtatcagaataaagctagcattatagagtaagttgggaagtattcccacttctgtattttggaagactttctaaaggattggaattaatcattctctaaatgtctgatagaaatgatcagtgaagtcatctgggcctgggctttactttatatgtaggttatctagttattaattccatcttttccattgttattggtcaattcaaattttctttctctttttgagtcaactccagttgttcgtgttgttttaaagtatttatccattttatatgtcatgttagtttacatatgtttcttcataatattccctaataagttttgtttttgcttttatgagattgatagttatgtcctctctttttgtgattttgatagtcttctgtttttgtcagcctaccaaaagatttgccaattttgttgatatttccaaagaacaaactttggcttgctgattttgctctctctattctacacttcatctgtgtctactcctttctctattatgttctttcatatgattgctttggattcagtttactgttgtttttcctgtatcttatattggaacatttggttactgatttgagatttttctcttgttaataaaggtatttgtaggcataaaaattatttcagcattgctttagttgaattccataagttgagttatgttgtgttttcatttctgttcccctcaaagttgtttttttttctaatttcctttgagatattttctctgacctattggttatttgggcacgtggtttttaatttacacatatttgtgagtttctaaaattttccttgtgctattctaatctaattccattgtggttagagaacatattttatatgatttcaattattttaaattcatgaaggtttacattgtgatatagtatactgtctatcatgcaaatatttcatgtagtttttagaagactgtgtattctgttattcatgggcatagtgttttattaaggtctattgggtcaagttcatttatactattttttatccttgttgatattctgcctagttgttgtatctattatcaatagtgggatattgaagtttccaactactattattgaattttcttatttctgctttcacttctgccatttttgtttcatgtattttccagttctattcttaggtacacacaatcttataattatttcttgctcatagacaaaacttttataattctaaaatgttcttatatagggaaattgttttcattttaaagtctattttatgttagtacagacactccagttctcttatgattccaattagtatgttatgttttttcccataatttttaaaatctatttataatttgaatctataatgtgtcttccacatatattatatatatgaatcgttttaaaaaaatccagtatgataatctgcctttacattgaactgttcaatctgtttatctttgatgttattattaatatgacttgattggcatttgtcattttgttttatttcttctacatttctcatgtccttttcttgttttttttcttttctgttttcattttcattaaatgaatactttctagtataacattttcattcctgtaatattttaacaagagcttcttagttatttataaatagttgctctagggcttacattatgcatcttaccttctcagaattaacttcaaatctatactaaattaaatggaatatagaatctttaccactatatagctctattgttttctgcccattttgtgaattcattgctataaacatgtcatatatgtatgtgcatatatatatgaaacctgacaatatattgttatatttactattgaatatgtttttatatatttttaaggaagctaagataagagagaagaacaagtatatatttacaaggcttcttacataatttttcttatttacactatctggttctctttattcctatagatcgaagttaccatttaacgtcaagtaggaaaatagtttttcctaccttctgcttttgttccgttactgtcaaatatattacatttctatattggtctcacaatacaattatcacattttataaaattgctttttacatatgttaagagagaaaaatgaatatacatttatattttattttaacattgcctgtgtaactgccaacatcaacactcttttttttaatgtcgattcaaattactgtatgatgttccttggttttagcatgaaaagcttcctttagtacctcctgtgagaagagtcttttagccacaaattatttgatagttttgtttctatatttttgtaagatagttttgctggatataagattcttggatgacagatgtttttcttttattgcctttcattcttctgtaatgtcatccccctgacttctggcagccattttttttatgaaaagccacctattaatcttattgcggttcacttgtatatgatgaggttttttttttttttttttttgttttttttgtttttttttttttttgctgctttcaaggttttgttttatctgtgagtttcaacatgttgactatgatacttctaggtatggatcctgtgtttattccaggtggatttttttaagtttaaaaaaatattttaatgtttttcatcaagtttggaaattttcagttattatttgaacacttttaatgctttttaaaatctttccttttggtactcccactgcaagtatattgttgtgcttaatgaggtcccatatttgtctgagctgttaattagtttaattgttttctctctgttcttcagtttgcataatctctattgatttaccttgaaatttactaattctttcctttgtcagttcaggcctactgttaagccctactagtcaatgtcattttcattattgtaccttctaactcaagaatttccttctgattctttaaaaaataaggtctctttttcttgatattattcaacaagacattgttaccatactgttcttcaattttttaaagtacattatttccctttgttttttaaacttatttatagcattttctttgaagctttgtctgagaagactaacatctgtgtaccctcaaaggcagatattattgccttatttcaattttgattatgggtctgatttttatatttctgtgcatgtttcataatattttattgaaagtggatattttagatagtatattatgtcaactttggatataaaattctgcaaggctacttattgctggtgtttatttctttgttgacatggctgggctacttcaatgaagtatctttctcctgaagtgtacaaccttgatatggtcctcagaaggtcacactttggcatgcaaacaattttcctgaccttcagggatgagtctggctttagctggactttgactctctcttttcttgatcttcccattaagcttatggttgatttactgtattgttatcccactgagatattagccttctccaactgctaactcatgggtttattattttcaacaatattctcagacattacttgctccacattgatacccagcctcttggcaggagcttggtgtaaggcttgctctaaccttctcctaggcagatctctttgctatggagcaggagttaggtgggaaaaacttgcttttcaccaggcattccctcaggattccccatataaagcaagcactgggcagggggagggggagtaggtaggcggatcaatgttgctctctggttgctgccaccacccagtatggaacttccacagcccagaatctaagagaactgaatattctgattttgaccagctgctgaatctacctggaatagttctttaattataggcaactggtggggatgggagctgccacctgcctagcaagccctctggagctctcctgattaacagagctatgtaggtaatgggtcttctttcctcacctgctccttggcctggatccatcctacagagcaagagttgcagacggggaattgagagctacgctgctgctactagccacatgatagaactcttctacagcatagggttgtaaaaacagaatctgctaatgttcactggttactgaaactactctgaatggctcttccacctcaggatattggggagattgggactgccactcagtcaccaagtcagggagttataataatagtcattagatcaaacggcaggatctctcacagttcttacatagtttgaatttcatttaataaattattctcagtttgttgctagccttttgatgaatctccagaggctttgagtaattgattttgataattgttaccagcttaatacatgtcttttcagggcagagttttctctaagcttctttccctacccttccagaagaaccactattgagtacaactaccaagttatcctagttagaacaacctagctaagcctagtcaacacacataacagttagagataataaaaaattattgttttaaacagctaattttggggtggtgtcttatccagtgatagataaccaaaacatgtttccggatctatttcaatttttttttaattgcctgttgtgggatatatgagtcaaggctgttaatctttactgagaaaagggaagataattattttgaacacataaacatatttgtaaaagtaagtatgttcacacatttttggaagtgacatacaatatcctatcatgactaggattccttaaacatcttttctagtataaaaaatgtgaagatgaaagatatttataatcttgttctaaacaacacactccaggttgcttttgggatcaatcatatgaagtgccagaattcttcagaatagctatcattctttattttctatccattttgtctcatccattataacaaggggcacagtgacagtccttctatttcaaaaaaataaaaagaaaggaaaaaagaaaaataagaagtccttgacattttttttgacatgggtctcatgaattttcttctcattatattatgcagttttcaaggctttgtaaatagaattttccatgtataactgcctaccactttaaaaaggtacacatagactttaactgcctatcaaatgtgaatgaactccaacttggcagaaaatagctaatatattcaacttgaatgccatcctttaccaatacttttaaatccctgcaaatctcaatttaagtcaggcagtattaaattaaaatactctttggtaattctgaaaacaacaatacttgttgaaaatatttaaaatgttatgcacatattttctataagaaaatttctgatgtgaagaagacattttgtgtttttttctgatgttatatttttcctttgaagtaaatcaagagctggcagttgtgctcttagtgagtttgctagcaagtcagggaacaagattaaaaaaaaaaaacagtgaaaattttagatatttatttggagtatagtttccagttcaatatctcctgcttctttaactatatagctttactaaagagaaaaaaatatatgctttggtatatctgtgccaagttagctatatctacatatgggtaactaagggaaatggttaactttaaaatggagatgaaatataaccaaagtatgtcatttaagtgatgataaactataatttatgaattacctaagaatatgacagttttcaaaaatctctttcaataccattataaagtataatacctatttggccaaggtggctgaccagaagcagctagtgtgagtcactctcacagacaggagagagagtggtgcataagcactagctcttcaagtggattgtacaggagtccacactgggattcatcaaggaaggaacaacagcccacggagagcagaaaggagacaggcaggacagccatctaccagggattagcatggagccaaaggaggctccctaccacagggaaagggtaagtgactgccctcaatctggggagggagtgaagggcgcatgaactgtggcatgcgtccagcatgtcacagctgctatacagaaagcagccagactgcttctcacttggcaaggcctcccaagtgagtttccagtgcggccaccctactcccacctgattacttcagtcactggaagctctgtgtttctttggggtagaattcccagagacaaccaacaggctctctgccattgccgttgtattgacacctgcccttgatgtacttggcctgaagagcaaacaaaaaccccaattgctttgctcacccctccagcgtgtggcagctactataatgtagaggaagccagtttctcttccctgtgaacccttggaccccctcctcttcaccaggcagggcccccagcttgggcccatagcaaagctactctatccctggctgaacattcccgtttgcagtggctctgtctctcttgagtagaaatcccacagacaacttacagcccctctgccttgaccattgccatggtacatgcccttgctgcccttgggctggggagtaaagaccctgattactttgcttgcacctccagcatgctgcagctgtcctgcagacaggaggccagagtgtctcacccatgagcttcccactcccctgctcttcacaatgtagggactcctcgcttagacctgtaatgtgccactccatccccagctgatcattccaattagcagtggctccgcatttctctggggtggagttcccaataacaagtgaaaggctttcagccattgtcgttgccaaagtctctgctcctgctgcctacaagctggggaatgaacaaaaagcctgagctcaccccatagctgcagtacacaactcagaaatgccaagttgagatctgtggccagcactccagcgggagaggagcctatactctcagagcactaagagggagcatggctgcaaacgtgagggaatagagaggagccatatggctgagaagagcgtatctgccagccattatgcttgagcgtcatctactgaattgcagcccaaactataacaccaaaaatactttgctaatatactcccctgtgaaaccaagggcaagaatttagccacaaaaatcctgcacaatggcttggccctctgaaaacatccagaaataaagccaactgactatactcaaattatacaacagttaaaggaacatcagcccacagagaagagaaaggaccagtgcaataactctggcaactctaaaagctagagtgtcttcttatctacaagtgaccatactagtttcccagtagtggttctgaaccataatgaaacagctgaaacaatgcacatagatttcagaatctagatggcaattaagaatatcaatattcaggagaaaggtgaaacccaatccaagaaatctaaggaatctagtaaaatgattcaaaagctgaaagacaaaataaccattttaataaagaaccacactgatctgatagagctaaaaaactcacttcgagaattttattacgtaattggaggtagtaacagcacaacaggccaagatgaggaaagaacctcagagttcaaacactggttcttcaaatcaactcagtcagaaaaaaaatttttttaaatttaaaaaatgaacaaaacccctgagaaatatgagattatgtaaacagaccaaaactatgacccactggcatacctgaaaaagaggaaaagatagcaagcaacttagaacacatatctgaggataccgtccacaaaaatttcctcaaccttgctagagaggtctacattcaaattcaggaaattcagagaacagctgtaagatactatgcaagacaaccatccccaagatacatagtcatcatattgtctaaggtcaatgcaaaagaaaatttattaaaggcaggtacagagaaagggcagttcatctacaaagagaacgccatcaggttaacagagaacttttcagcagaaactctacatgcccgaagagactggtgggactatattcagtactcctaaggaaaaaaattccaacaaagaattttgtattcaacctgaagcttcataagcaaagataaatgaaatcctttccagacaagcaaatgctatgagaattcattaccactagacctgccttataagagctttttaagggagtgctaaacatggaaatgaaagactgttaatggccaccacaaaaatgcacttatatacatagaccactgatactataaagcaactacacaatcatgtttacataataaccagctaaaaacatgatcatgggatcaaatccacacttatcaatattaacaggctaaatgccccacttaaaaggcatagagtagcaagttggagaaagaagcaagacccacctgtatgctatcttcaagagccccatttcacatgcaaagacacccataggctcaaagtaaaaggatggagaaacatctttcaaacaaacggaaaccataaaaaagcagggattgctatttttgtttcagaaaaaaacagacttcagaccaacaatgatcaaaaaggacaaagaaagacattacagtatgataaagtattcaattcacaaagaagacttaactatttcaaatatatatgcacccaccaccggagcacctagcttcataaagcaaaatatcagagagctacaaagagaatgagatgaccacacaataatagtggaagacttcaacaccccactgacagtattagatagatcatacgcagaaaattaacaaacacatttgggaactatactctacacttgacctgacaggcatctaaggaacactctgcccaacaagaacagaatgtgcattttttctcatttgcacatggcatataatctaaaattaatgacacactaagccctaaaacaattttcaacaaattcaaaaaaactgaaatcatgccaaccacactcttggaccgcagaaaaataaaaacagaaatcaatgaaaagatttcccaataccatacaattacatgtaaattaaataatctgttcctgagtgacttttgagtaaacaaaggaattaaggcagaaatcaagaaattctgtggaactaaagaaaaccaagatacaatgtaccagtatctctgggacacagataaagcagtgttaaaaggaaagtttacagcaccaaacgcccacaccacaaacttagaaagatctcaaattaaccatctaacatcacacccagaagaaacagaaaaacaagaggaaatcaaccacaaagctagcagaaaaaaagaaataaccaaaatcagagcctatttgagtgaaatggaaatgacaaaaagatacaaaaaatcaaggaaactaaaaattgtatttttgaaagactaaataagattgatacaccagtaactagactaatacagaaaaaaagagagaagatccaaataaacacaatcataaatcacaaggaggacactaacaccaaccctacagaaatacaaaagatttctcacagactattatgaatatctctatgcacacaaagtggaaagccagaagaattagataaattcctggaaacatacaacctcccaagattgaaccaggaagaaaacaaaaccctgaagagacatataatgagttctgaaattggatcagtaataaaaaagctacaatcagaaaaagctgtagaccagtcagattcacagccaaattttaccatgtgtataaagcagaggataacaatcttactgaaactatccaaaaagtcaaggagtagggactctgccctcactcatgagaaagcaggcattattctcatatcaatacttggcagaatcacagtgagaataaaaaataaataaataaaaaacttcaagccaatatccctattgaacacagatacaaaaatcctcaataaaatactagcaaatatcaagcagtatatcaaaacctaatccaccatgattaagtaggctttatccctgggttgcaaggttggttcaacatatgcaaatcaagaaatgtgattcctcacataaacagaactaaaatgtaaaaccacatgatcatctcaatagatacagaaaaagcttttaataaaattcaacattcctgggtgttaaaaacccttaaaaaactatgcactgaaggaatatgcatcaaaataataagagccatctatgagaaacccacagtaaacctcatactgaatgggcaaaagttggcaacgttccccttgagaaccagaacaagacaaggatgcccactctcatcacttctattcaacataatgctggaagtcctagcaaaagcaatcaggtaagagaaagataaaaagcatgcaaataggaagagagagagagtcaaactatccctgtttgcagaagatatggttctatacctagaaaacctcataatttctgcccaaaggttttcacatcttataaacaacatcagcaaagtttcaggatacaaagtcaatgtagaaaaaatagtagcaagcatttccatgcaccaataatttccaagctgagaaccaaatgaagaacacaattcattcacaattgccacaaaaagaataaaatacttagaaacagaggtaaccagggaagtgaaagatcgctgcaacaacgattgaaaaacactgctgaacggaatcagcaatgacacaaacaaatggaaaaacattccatactcataggtgggagggatcaatattgttaaaatgaccacagtgcccaaagaaatttacagattgaatgctattgctatcaaactaccagtaacctttttcatagaattataaaaaaattctgaaaatcatatggaaaaaaagagcttagccaaaacaatcttaagcaaaaagaacaaagctggttatatcacactacctgacttcaaactacactacaaggctatagtaatcaaaatggcatggtactggtacaataacagacatatagacaaatggaataggttggagaaccaagaaataaggctgtacgcctacaaccatctgatctttgacaaagctgataacaacaagcaatggggaaaggactccgtattaaataagtggtgctgggaaacctagcaagccatatgctgaagatttaaattagatctcctttcccttaccatatacaaaatgaactcaagatggattaaagacttacatgtaaagcctaaaagtgttaagaaccctagaaaaatagctaggaaattccattttggacattggcccaggcaatggtttcatgatagagactccaaaagcaatgcaacaaaacaaaaactgacaagtgggaccaaattaaactaaagggctcctgcacagcaaaagaaactatcaacagagtatacagataacctacagaataggagaaaacatttgtcaatgatgaatctgataaaggtctaatatccagaatctataaggaacttaaacaaatcaacaagcaaaaaacaatcccattagaaaatagacaaaggacatgaacacacacttttcaaaggaaaccatacacattgccaacaagcatataaaaatgctcagcatcactgatgattagagaaatgaaaatcaaaaccacaatgagagaaaatcttcaccagtcagaatggctatttattaaaaagacaaaataaaaacagatgctggtgactttgcaaagaaaagagaactcttatacatggctggtggaaatataaatgagttcatccactgtggaaatctggagatttctcaaagaacttgaaacagaaataccatttgacctagcaatcccattgctgggtatatatctaagggattataaatcattctactataaagatacatgcacatgtacatatatcacaacactactcacaatagcaaagacatggaatcaacctaaatgcccatcaacagtggactgaataaataaaatgtggtacatacacaccatggaatactatgtagctatagacaaagaacgggctcatgacctttgcagcaacatagatgcagctggaggacattatcctaaacaaattaatacagaaacagaaaaacaaatactgcttcttctcacctacaagtgggagctaatcatttagtacacatgggcacaaagtcaggaaaaatagacaccagggcctatttgagcgtagatgttgggaggagggtgaggttcaaaaaaccacctattgagtactatcgaaaaaccacctattgagtaccacattcattacctgggtgatgaaataatctgtacaccaaacctctgtgtcatgcaatttacccatgtaagaaacctgcacatatacccctgaacctaaaataaaaattgtaatggaaaatatggacctattcaaacttagaaaaatattataattaaatggctgtcaacataagaaacacttagcagagagaaaatattatgaaaatgataacatctctggttaccttatagcatattttccctttctgcacttttctatactcagtttcataagtataataataattgtataaattaaaattaatatgtcaaacttacaaagaaaagtgttgtgttataaaaaccatatgttttaaaagtgctatggtatattttctctcttaagaaaattttgacttcttgcagttttttaatggtaaccttaattagagaaaacctgttattcagttaggtaagtatcctcaatatttctgtagaatctccaaagtggtaggttttaaaatatacatttcagtatcaaaacccctcaaaactaccatcaaatttgtcagataagcctacagcacaaacccaccaaaggcccccataatgtagaacaataagtttagaatattttcttgagtttattcaatggactacaaatttaattaatagtttaataactccatagtattacatattccttgaaaaaaatacatacatatattttaaacaaaaaattgtatttcaactaaaatgtttataaagatcacaatgttcaagtataaaattatgtgatactgtctaaaaatcataacaaaaaaaaattccagaagctaaaaaactgaacacacatactctcccccaactttcaaatttgttgctttggaagcccatatgctaaaatctcagcaaggaatgcatagcaatcagcaaataggtatgtgaattcataaatatgttttttcccacattaggaatcctaaaaggatgggatttttaaaaacgatatttgattatttatttagagacagagtcttgctctgtctcccaggctggagtgcagtggcatgatctcggctcactgcaacctccacctcccaggtttcagcaattctcccgcctcagcctcccgagtagctgggattacaggcgcacaccaccacacccggctatatgcaccaactttcttaaaagcagactttaaaaatctgatttttaagaaaagacatataacttcaattggagcttcattctggttttgtgcccactttgtgataggtcctagaagtactaaagataatatattcacttttaaatttcatgagagaagcctgggcaggaaaaaaaaataaagttaagcagaacatttacagatattttgctttctgttttaaaaagagtttaaaaaggacactcgtggcctcatatatttacttattaatgttagattagagatggagaagataaaaatgaattaatcacagattatggaaaaacacgaataagtcaggtaatatagtcaatataatttatagaaaactgcgcattttccttggtgctgcaaaacctggatatccatatatagaagaataaaactagacccaagtctcttaccatgaacaaaattcaattcaaaataaataaacataggacatgaaactataaaactagtagaataaaatacacagaaaacacttcagaacgttagtctaggcgatgattttatagctaagaccccaagagcacaagcaactaaaacaaaaatagacaaatgagaatatattaaaataaaaatattttgcacagtaaaggaatcaattagattgaagatccaacctgttcaattatagggaatatttgcagaatagtcatacaacaaggaactaatgtccagaatatacaagtaactcaaatgactcaacagtaaaataaacaaacaaaaactgaatactcctattaaaaggttggtaaaggagctaaatagacatttatctaaagatatacaaatagccaagaggcatatgcagaaatgctcaacatcattaatcatcagggaaatgcaaatcaaaaacaccatgagatatcatcttactcctgttggaatggctattactaaaaagagaaaaaatatcacagatgatggtgaggatgcaaaaaggagactcatatattgttggtgggaatgtaaattagtacagctagtatgaaaaatagtatggagatgtctcaaaataagaaaaattgaattaccatgaaatccagcaatcccactatgaggtatttattcaaagtaaagcaaatcagtatgacaaagtgatacctgcactctcatgtttattgcagcactattcacaacagcaaagatataaaagcaccctaaatgtcaacaaatgaatagatcaagaaaatatgattattaacagaatgtaattctattcagccataaaaaaagagttaaaccatgttatttgcagtaacatgactggaactggaggtcattatattaagtgaaataagccagacacagaaaggaaatgatcacatgtactcactcatatgtgggagctagaacagttgaatttatggagatagtatgtagactgatagttaccagaggctgaaaaagatgtggatgtgggaagtgtctgaagagaggttggttaatggatacacacagaaggaataaattctaatgtttgatcacagactagggtgactacagttaacaacactgtattgtacatttcaaaataggtagaaatgaggacttgaatgttcttagcacctagatatgataaatgcttgtgggtttggatatcctaaataccctgactttattattatacattctatgcatggtacaaaatatcatatgccccccattcctatgtacaagtgtgtaacaattaaaaaaatacctaaagcagaattgacacagatgatacaattggtaaccaatatgtttaagaagccagagaaaacatatataatattaagtaaagacatagaatacaaaatatactctaaagccaattttattgctaaaaacgtcagtgactaaggtgaaaactatactgggattaaatatagaatagacaatgagatgtaaagattaagccatctgtaaacatgccaatataaagtatctaaagtgaacactagagagtaaaaatactgataaatgtgaaaaggagcacaccaataagatttggcacaacttaaagcaaactaatatacatgtattaggaccccccaaaggaaagaaaggagtgaaaggaaattatatttaaaaataatagacaatataaactcaatatttctacaaaagctaggcacaaggaacctgaaaacaactatagcaatgaacatcttaatcagactatgtaacaacagtggtaaaaacaaacattctaaagcacccaggaaataaaagacatatcacaagcaaaggaactaaaacaacgagtaaaggaaaaaagataacagcatatcgttttttgttgtttttgttagaaacaatgctaagaagtaagcagtggtacaatatatttatagtattgaggtaaaaacggccgtcaccttgtaattctgtatccactgaaaatatttttcaaaaatgagagtgaaataaaggcatttgagatacacaaaagcctcaagaattggccaccagtagacctttactacaagaaatcttaaaggaagttatttatgtaaaggaagttattcatacaaaaggaaaatgttaccaagtggaaatcctgggttatgcagaagaatgaagaacactggaaatgtttcttattatttaattagttttaaaaataatttactcttcacagcaaaaataatgagttctgggttttatatgtaaaaatgtgacaatgatagcacaaaaactaggaagagagaaatgcaaggagaatgttctaagtttcttatactatatatgaagttgtataatatcacttgaatgtaactgttgtaatttaaagaggtagatcataaaccaaaaagaaagcactaaaatagcctaagaatgaatttagctaataaaaatcaaaggataaaattaaattattaaaaatactcaagaataaaaaagaaaaaaatgaaaaaagagaaaaaataacaaagcaaatagaaaacaaatagcaagatggtaaatttaaacccaaacctttcaacaatcgtatgaaatatacatggtctaagtgagctagtaaaaaggaagatcctatagaactggataaaataggaataccaaactatattttgctaaaaagaaactcactttaaagacacaagtaggttaaaagtaaagagatggaaaatacctaatctggttatactaatcataaggaagctggagcatctatattaatatctgacaaaataaacttcataacaaatgaatgttcccagggataaaaagggccatttctcaatgatatattggtcaatttaggaagaatatataatcattctaaactttcatgcacctcaaaacagattttcaaaataagtcatacaaaaagtattttaattgtaaggggaaatagaaaaatccataattgcagacagaaatttcaacattcctctctttacactttataggacaagtagataggaaatcagaaatgaaataaaagttttatagaatacaataaccaaattaacctaatttacatttgtagaacattttctctcttgatggaataatgtattcttttcaaatgcatacagagcatgcaccaaagccaaacctactctggacaataaaacaagtgtcaaatttaaaaggattcaaatcataccacatatgtgctgtgaccacactagagtacaattagaagtcaattacagaaagacagctgggaaattctcagatattatacttttaaataacttaagcagtaaataaagatcattgaaattggccaggcgtggtggctcacacctgtaatcccagcaatttgggagggggaggcgggcggatcacttgaggtcaggagttcgagaccatcctggtcaacatggtgaaaccccgtctctgctaaaattacaaaaattagccaggtgtggtggcgcgtgcctgtaatcccagctactgagaaggctgagacaggagaatcacttgaacccaggaggcggaggttgcagtgagccgagatcacgccattgcactccagcctgggagacgaagccagactctgcctctaaataaataaataaaataataataataattgaaattattttgaaccatatgaatatcaaagcaaaacatatgaagaaatgtgtgatgtggctaaggaaatgattacattggaatttttagcacaaggtgcctatatttgaaatgaaacaaggtgttaaccaacctcagtgtttaccttaagaaacaaacgaaagaacagcaaattaaatccaaactaaacagagaaatataataaaaatccagagtgaaaattaataaaagatatagtagaaaaacaacagagaacacatgtaataaaaatgttagtctttgaaaacatatatggatggcaaatgagcacatgaaaagatgatctatagtgcaaaataaaataagatacagtgacatacctataagaatggcttattttttttaactgactatatcaaatattggcaagaatatgggatgactggacctctcatctactattagtgggaattcaaaatgatacaaatgctttcaaaagaagttcaaagtagtcctgaaaatgttaaacatgcacttaccatgtgtccagtcattctgctcctagttatatcttaatagtagtaaactcatatttgtatacaaaggctttacaaatgttcacagcaactttatatgagcaaaagccacccaaacaaacagaacacacacacaaaataacaaagcagaagaactccaaattatccatctacaggtttataaataaagtattttggtatatccatacaatggaatattatttagcaaaaataaaggaagaaactattaaacaggcaataacaatgatggatttcaaaataattatgctgtgtgaaagaagtcagacaatataaagtgtaaatagtacataatttcatttatataatgttctcaaaaatacaaatgtatagtgacagaaagcagatgaggggctacctgggggtggaagtgaaaggtaggggtagttgtgaaaagatgaaaaggaggttggaggaaacttttggaagtgaggcatttgtttattttaattatgactgtgttatcacagaagtatatatcaaagcttacaaaattgtacatgttaaatatgtgcagttctctgtataccgagtatccctcaataaagctaagatttgtaataatcgattacacaacctaacctttatatgtataaatctataaatgttacaaaatgtaacggagtggtgcaagatgggatgcattttgtggtgaactaattgtttttgaaattgtacatattcttccctatgtctagatagtgtgacataattgaatgtaaaatatcaaaataccagaataatagccactgatctcaactaaacagctagcaaaatttgggcagtatatttatcctctcagttcatttatgaaacataggggttttcctcaaactcttcccaattctcttgttctatatctaaatctaggcaaaaaaataaataaacttctggtggagccccacccctcagttgatgtatgactatgtcaacaatgcccttagattagacacaatgatactctttctaaagtgctaaattttccaaagtctcaaaatattccgaatatgagattgataaaggaagcaagaaaatgtaaaacaaggcctatctccagtattgtagctctcttttggtaatctttacatatctctctcttctctcagtttcctttcttacatggaggtatttgtttatattttccccaatactttccattttgaacgttagttatcatggtataaggtttcacattcaacatttcagcagtgatcacaggagtcactaattgtaactgaagtttgaacgttcaagcatctcattacccaagtctctagttagatattaaaaagtaaagtaacaattataattcttaaaaatttaagaattgcacaaaactctaaggtaggtattatttagttaactgtacagaggtgaaactgatagaataatgattaagttatactatctatatgatgctctataccccactcacatttagtctagattgaaattaaaactatccctgcacagtactttatcttacaaaaatcactcatatttcataagctataataagataaaagcttatggattttgatgcctagccttcacctttcctattgccattatgtacaaaagaaaaattgattctgaccttgaagtcacagtgttaaaaataaatctctgcagcactgatgtttcttttctgtctctgaaataactgtttaagctcactcaggggattactctaatgatctactagctttttataagttctgaaaagaagtaaaagagaggtttgtgtagggaagtgtttatcagttcctaacacatttcaaggaaaaatatacgtgtgtgtaaatggtgctgagtatccccacacagatatttcatgtggcctatatcaatcaagttaatatctactattgagagaacatgtattttccaatcaccttgggggaaaattaatgttttataatccataaacatatggaattcacaatgacagaatatttatttaaaatatttacttacaaagccaacatgattttcaattgatggcatacataaagatgggacaaatcatgcctagtaacaagcaaatacactttattttaaattttctaattatggtccttcattaatcttgatgtaaatttaaattaatgttttactaacatatgcctaattgatcattgtggtacacattcactatattactttttatacaaatttagttatgtttattgtagaagatagacaaattacacaaaaaaagtattaaaagagaaaatatacatcccctgatatattacaagaatgtaattctctaatttgaactcctacataagaaatcaactgagattacaaaggaagtagaaactgacacaaaaaaatactgtacaatcaccatccttgagacaactacgactttaatgaaatacatttattaaaacacagagatctttttccagtaatgacagaataaggtcttaccagaatgcagaaaacaaataaaaaactgaaaattataccaaaagagatatatgaaggaaatggagaatgaagagaagattccagaatctagtggtgagtacctactcaaagaggggagtgtaaatgaagtgaaagtccattttcatgaatttgagcctggggtcaggtacaattattcagtgtgtgttgttgcaggataactgctgggaaaactgtggtgtttttggtccagaaagtcagaaaactgaagctgaggaaactgtgcctgaagaacagcatgagggaatccaggaagtggaagttacagagagaaaacacctaattctctctgtccatatttgcgcctgatccctgacacatgcatgcacagtgtgtatgagccattgtttgccaactctagcataaaggacagcggatatatggacctataggactgaatagtttctacaattcatgtaaagtgataaactatttactataactggaaagtacaaagttaaagatgcttgatttttcagtaataatacaaagacgtagagttaaaataaaaattatcacataatttttttagtatactttaatgtttccagtagaaataaaatttgaaaatataaaactgaaaggtagacaggaaaagagaaatagataaaaagaagaaataggaaataaaataataaaataataaataaataataaaataaataataaataaaacaataaataataaataaaataaacaataaataataaaataaaaagaaaaacacaaactaaaccatataaatagtacatttaatattagtagacttcaatcaaaaggcagagattttaagaagggattttaaaaaagagacctagcttgctgtctacaagagatgcactctaaatatagagtcacaaataggtagaaagcaaatggatagaaaacggtataccacaaaaatagtaagtataagaaggctaaagtggctatattaatgaaaaaatagatattaaaacacacatactaccaaagataatgagaaatattttctagcaataaaggtgtcaattctacagaaaaatattatgaatgtgtatgactctaataatagagtttccaaatgcacgaagaaaatattcacataaataaagcaataaatcaataattccaaaatcagaattgaggattttaaaagcccactctcagcagttgatataactgagcaaaaattcagcagacatacaaaaataaaaaaaatatacttatcagttgacttgactagtatttatggaagtcaaacacaataacatcagaatatttattcttttcatgtacacacagtatgttacatgatagacaaatatgctgaaccataaagcaagtcccaatgatgtttaaaagaatggaattctgaccatgatataatcaaatatgaataacaaaaaactaaaaagaatttggaaactaaaacacacctttctaaataatagatgagtcagaaaagaaatcaaaaaagaaattatgaattgtattgaactgaatgataaaaagtaaaagttgagacatgtagcttaagcagtttttagagggaaatttatacctttaagtatttgtgttagaaaagaaggaagtataagaagtaaaagaaagaatggcaaattaaactcaaagtaagtagacagaaggctttataaagctaagagcagaaatcaacacaattgaagaagtaaaccagagaaaatgaatggaactaaattctggttcttggaaagataagtaaaatatgtaagctattttagaaggaccaaattaaaagaaatacaatggaaataccaatttctggaattaaagaccaggcatcacagcagatcctacagaaattaaatggataataggagaatataatgaataacactatgcccataaatttgacaacctagaataaattttttaaaggataaaaatgaacaaaactatgcaaagataaacagaaaacttaactactcttatgttaaatatggacatagccctaatgaacatagatacaaaatgctttaatgttttagcaagacgaatctaacaatatgtaaagataatacatcatgaccaaatgtagtttatcaaagtaatataatgttggtgtacacctcagtaagatgacagacatcccaactgtatgtatgtatttatgtatttatttgtatgccatttgtcatattcgttttttaagctttgtcaaggtatatataacagacatacaaaaatttacattgttaatgcctacattttgatgaatttatatatataaatatatagtatcatcaccatctagatactaaatatatttatcacttccaaaaatgtcctggtgcttttgtgtgagtgtatttctgtgtgtgcataagaacacttaacatgagatatatcttaacatattttaaagtgcagaatactgtactgtttactgtattatgctgtacaacagatctctagaacttactcgtctagcacaactgaaattttatacccattgagcaaaaatttcacattacccctcccccatcctggcaactatcattcttctgtttctatgagttcaaatatttgtggtacctcatataagtggaatcatgcagtatttgttctgtgattggcatacttaacatcacttaggtttgtctatgctgttcacaaagagtaggattgtcttcttgtttaaagctttgtgatattccattgcatgttttcaaatccattcatctgatggatatttgggtttttttccatattgtgactattatgagtaatgttgccatcaacatggaggggcagatatatcttcgagatcctgatttcaattttttgggctacatatctataaattgaattgctagttaatatgggagttctatttttaattttttgagaatattcacactgttttccatagtagctgcactattcttcatttccaccaacaatgtataacagtcccaattcctccacatctttatcaacacttgacattttctgttttttaggtaatggtcatcttaaaaggtatgaggtgatatttcattgttcttttgatctgcatctccctgaagatgagtagtgttgagcaccctttcatatatctcgtggccatttgtttgtttttttgagaaatttcaattcatgtcctttgccattttgtaattgggctttcttcctactgagttgtaggagtttcctacatactttggatattaatctcctatcagatgcacagttgctaatatttactttcaacacagagcttgactttttactctactgtgttgactgtctcctttgctgtgcagaagttttttagtttttctattttggggtttttgcttgtgttttggtgtcatatctaataaatcattgccaagactaataaagaaggtcataaacaaggttttcctttatgctttcttcaataagttttacaatttcaagtcctacatttaagtctttaatccattttgagtttatttttgtgcacagtgtaagacagggttccaattgtatactatgcatgtcaatacctagtcttcccagtatcattcactgaagagactattctttccacactttgtgttcttgacatccttgtcaaagatatattgactgcatatctgtgggtttatttctggaatctctattctgtttcattggtctatgtgtctgtctttatgttagaatcccactgttttaattattgtagctcagtaacatattttgaaatcaggaattgtgatgcctccagctgtgttcttctttatcaagatgactttggctattcttttgtggttctatataaattttagaattgttcatttctgtaaaaaatgtcattcagattttgataggaattgaatctgtagatcacattgggtagtacagacattttaacaatattaattttttcagtctatgaacatgagatgtcttttcatttatttgtgtctgctttaatatatttcatcagtgtttcatagtttccatgtatacgtctttccccttctaagttatatttattcctaaatatgttattatttttggatgatattgtagacgttattgttgtcttatttcctttttagttagttcattgctactctgcagaaatacaactgatttttatatgttgattttctatcctgcaacttttatacatttgtttattagtaacaatctgagtttgaaatgggcaaaagttttaaatagacacttcacaaaagtacatgcaaataaataaaaatcacatggaaagccacttaaagtctccaggcatctaagaataaaaactgtccatggaatgaaaacactacagatacagtaatgtggctaacgttaaaactattgaacatatcaagtgctactgaggatgtggaacaagcagatctatcatacatgtttggtgagattgcaaagtgatcaaatattctaaaaaacagtgaggccgtatcttataaagtaactgagacaacaaccataagaccttacaattttactcccaggtattttctaaattaaaaatatgctgatatattatgtatccattattttaatagaccaaaaccagaaacaatccaaatctccgtcagctggtgaacagataagcaaattgtggtatattccacactgtggaatactatacagcaagggtaagatattaattagtaacacatgcaagaacatggataatttagtgaaggagatcagacacaaagtactacatattatatgacaccatttgtgtgaatttctaaaaaaatttagggtaacatgaaaaggacaagtggtgtcctgggaccagtggttggtacagggaatcaagagttcagaataaaaaaaatagagtcatgaaaatattccacatttggaatgtggtagaggttacatgcctatatagaattattaaaattcatcaaactttacacttcaaatgagtacattttatgatatataagctatatgtcagtaaaatgagacaacattttaaagtctcaaagcactcttgttggttttttgctctacattatttacatcccagtttgagtattttagattttttttttttttttgtatttttactccaagctttttgttttctccatcttggtaacctctcaattttaggacttcaactattactttaagttgtcatgtttaggctataggcctcacataatgacctgggttcttatatatctctctggcatttcaaactcagcattcaaaaactgaaatgagtctaaccctttcagatttatctccccagtgttgccagtatgatctttacgaagagctgctctcatcatttaattcttattataagcttcagtggccccctgcagctgtaatgatgcaatctctactcctccatcacaaggagtaggctttatgatttgactttggcttagttcttcattatctacatcatggctcaaaaattaaaatgtttcagggtgtgtgtgaaggaggcagaatgaaagggaaaaaagtagtacaggcacatttcatcaatgtctccattgtcaggaatccacaggtgtgctggtgaaatggagagtgaaggcatcacctggggactttaggaagttgtcctacagctctgtctactgggcccagatttcatagtaaaatgttataactagatatttgaaagaaaaaaaacatacttataaatgttaaacactgagtaaaccaagtgaaatcttccagcagtctggattgttactctgtagaaatgcagttgatttttgtatgttgattttgtttcccgcaactttgctgaattcatttattggtgacaatccaagttttaaattggcaaacattttaaacagacacttcacaaaaatatgtatgaatgaataataatttagactttccacatggaaaagccactcaaaatctccagacatctgagaaataaaaactggccatgatatgaaaacactatacacggtaatatggctaacattaaagctattgaacatactacctgctactgaggatgtggaacaaatagatatctcatacatatttggggagattgcaaagtgatcagatactctgaaacacagtgagactagcaaataattagcccagcaaaacactgtcttttgtcacctgaaaaagccttatgtatatatacattctttagcatttaacttagttatcactactaaggaaggcttctttaatttcttctttaagaaagtagtatgattttaatgcctcttgtttgtacttccaggatatttaatacttactgtctactctatcagatgtagtttataaatactttactaatactaactcatttaatctccttctcaacacaatgaagtaggggctttaattattcccacttcacagattgcgtaaatgtagcacatagcggtttagtaacattcctaaaatatacagttagtaaatagtgaagtcaggattcaaatcctgataatataacaagagagcccatattattattcaccatattgcaatgattctcagattttatgacatggtactgtaacaatcagtgtgtgtatgtttgctctctgaactgttaaatacttaatatcaggggttctgttttactttttctttaattcaccaggcttagaacttattaagcacctactaaatatgaattgaatgaatgaatgcatgaattattgaataagatgaagaggtatggaacattttcaatactgtttctattatgtttaatgttcagaggctacatacgcaatataaaattccaaacaatacaaaaagttgcaaagtatagattgtatgaattaaaattcctctattttttattctgtcttgcttcccctgtccctaaggataatttccagagattttatattctttgagaaattttacaagaatccctatgatttgaaaaaggaatacagaatcaacataagtaaatattaggctctattttaagaaaaatactcaaattctagtctcaaaagagattaaagtaaacattctatagcctttatttttctttaaaactattagaaagtcatagtgtagcttatcttaactattttatctagggaaattaaactacagtgtttattttaatattgccaatgctattaaatttaaacttgaatttgaactgatgtaggaaaaatgagctagtctaagccactcagaaaatagtagcctattggttgtcctgcaacatggaagggaaaactagcaggatctggactcaggacagacgctgcttagcaaattccaactacaaattagttggtgggaaggagatcaaaagacctaagtatacaaacacttatagattgatgaccagtactctacatgtatgatcaggattccagatagcttgatgagaagacagaattgaggcataaagaggtacaaggctgaaacattacttaggtaataagtaccagacagataaaaacttcttattgtgtgatacaagaattaacaacacctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatgggtgaaattggaaatcatcattctcagtaaactatcgcaaggacaaaaaaaccaaacaccacatgttctcactcacagatgggaattgaacaatgagaacacatggacacaggaaggggaacatcacactctggggactgttgtggggtggggggaggggggagggatagcattaggagatatacctaatgctaaatgacgagttaacggatgcagcacaccagcatggcacatgtatacatatgtaactaacctgcacattgtgcacatgtaccctaaaacttaaagtataataataatgataataataataaaaagaattaacaacaccaaatacaaggcaatactgttgctatatcaaatctccaaataaaacctcaaaataacagtaaatatattctacttctttggagtgcctatgtttggaaggagttggactattttactcagtgcctacaggctgactatgtctggtaatccatcaatcaaataattactttccccaaggctcccttacggcccatctccagagaaaagaatctgcggctctgcatctgagcaagaatgtgtcagatacattttcaaacagccaattctgccacgtgcaagcatgcctaggacctaaagcatgttgctctttttagtcaacaatacagataattagggttatccctgggcttctgtcagggatttcaaccataaactgatgaaatccagggcttgtcaaaatcatgctggcagcatctgttagttgtgggaaaattttaactatttattaagtatcaattaggtatcaagccacatgtggaaaagcattaggtattatgaatataaaaactttaggaagataggcaggaaaatggcagataggagacaagactaatgtgaagctcccacttgacagaacagtacgtgcagactcacattgtgaacttttgctccaagaactagcacaggaccatactaggaaaaccaaaagaattcacagaccctttgaaagcagaagcttgctgctgcaaactccataagacatctgaaaactgttagttcccaatgtgtgagaggggaaaatctgcctccagacactcatccccactggggaaccttaaaatccagatcacggaagaaggatttaaccttacctagagttgaaacagatttagagagccaagtgaaatataaagtagaagaagcaatgggaagagccccgtaggcagtcctggctcccagcttgagcccaaggaagccatccctggctttatttcacaggggtccttggggaaggcagccagtggaatgggggaggggccacagggtgaaggaaagttctagctgaactttacaataatttccactgagtatgaattttcctgagcataatccaggggggcgaacaagaagtgcagataggatacgagcacagaagccacagatgatggtgcaggcagctggcgaggggtgagaactgagaattctgtttgctttctcagtggggaggctggtagcctggggcaagatctgagccctgtgcaccagcagcctggatataaactctgacctatggcagggcgcaacagcgaggcctgtcactgccggatataccccaaacttccctgacaacctgtatgatgcagcagagtcagccacaatcccccttggaacataactccattgccctgagaaccaacccccccgccccacagaggccttagcaagccccacccaaagacagcctgagctcaggcctgcctaattatgcccccagctgatggtttttctctacccaccctggtagccaaagacaaaagacatgaactgggagctacttggccctgcccatcacctgagaaacctgaacacctatcctggccaaggtaggcaagcttatatcccacttctactactgcagctggtgctctcttgaaagtgtcactccctggccagaggccaaagatctcaagccattacatcaagtgataactgaataaccctgctccaaagaaggagaaaacaacagctacttttaccacttgcaacttcttggctaatcagaagtcctgagtctgtccacctggcaacttcactgctagcataaccagcatttgagaaaaccagcacactaaccaaaactacaactaaggaccctcacagagtccacttcactccctgcaacctccgctgaagcatgtgctggtatccatggcttggaggcctgaggatggatcatttcacaggattttttgcagacattccacagcacgagccagagcctggtagccctgatgggtggctagacccagaagggcaataacaatcactgcagtctggctctcaggaagccccttccctaggggaagggggagaacaccacatccagggatcaccctgtaggacaaaataatctgaacagtgggtcttgagatccgttctttccactgaaacagtctacccaaatgagaaggaaccagaaaagtaattctggtaatatgacaaaacaaggttctataacacccccaaaagatcatactagctttccagcaatggatctaaaccaagaaatctctgaattgccagataatgaattcagaaggttgattattaagctactcaaggacataccagagaaaggtgaaaaacaacataaaaaattaaaaaaaaaaaaccaaatacagggaaaggatgaaaaagtctccagagaaataaatgtcatagagaaaagacaatcacaacttctggaaatgaaagacacacttagagaaatataaaattcactgaaaagtttcaacaatagactagaacaaatagaagaaagaacatcagagcttgaagacaaagctttctaattaacccaatctgacgaatacaaagaaaaaagaatttttaaaagaataaagcctcaaagaaacttgggattatgttaaacaaccaaacataagaatagtaaatattcctgaggaagaagagcaatctaaaagtttggtaaacttatttgagggaataattgaggaaaacttcacaggcattgctagagatctagacatccaaatacaagaagctcaaagaatactcagaaaattcattgcaaaaagattatcacctaagcacatagtcatcaagttatctaaagtcaagacaaaggaaagaatcttaagagctgtaacgcaaaagcatcagataaccaataaaacaaagctgatcagattaacaacaggtttctcagcagaaaatctacaagccagaagggattggggacctttatttagtttccttaaacaaaagaattagcagccaagaatgttctatgaagtgaaactaagcttcataaatgaaggagagataaagtcttttttcagacaaacaaatgctgagataattcactaccaccaagccagaactacaagaaatgctaagaaggagttctaaatcttgaaacaaaaccttgaaatacaccaaaatagaacctccttaaaccataatctcatcgggcctataaaataataacacaataaaagaaggtattcagacaacaactagaatgatgaattaaaaagtaacacacatctcaatactgacatcacatgtaaatggcctaaatgctccacttaaaagatagagaatggcagaatagatagaaattcatcaaccaagaatctgttgtctgcaaaaaacttatctaacataaggactcacataaacttaaggtaaagaggtggaaaaatatattccatgcaaatggaaaccaaaattgaggagtagctagtcttatatcagacaaaacagatttaaaagcaatgacagttaaaaaagacacagagggacattatatagtgataaaaggatcggtccaataggaaaatattacaaccctaagtatatcagcacctagcactggagctcctacatttataaaacaattactgctagacctaagaaatgagatagatggcaacacaataatagcagaacacttcaatactccactgacagcactagacaggtcatcaagacagaaagtcaacaaataagcaatggacttagactatacgatagaacaaatggacttaacagatatttacagaacattctacccaacaattgcagatatacattattttcatcagcatatggaacattctctaagatagaccatatgataggtcacaaaacaagcctcaataaatttaagaaaatcaaaattatatcaagtaccctctcagataatggtagaataaaattggaaattacctccaaaaggaaccctcaaaactacacaaatacatagaaattaaataatcttctcttgagtgatctttgggtcaacaatgaaatcaagatggaaattttaaaaattatttgaactaaatgataatagtgacacaacatatcaaaacctctaggatacagcaaaagtggtgctaagaggaaagttcagaccattaaatggtacatcaaaaagtctgaaagaccacaaatagaaaatctaagatcacaccccaaggaactagaaaaaccatgaacaaaccaaactcaaacccaagagaagaaaataaataacaaagatcatagcagaactaaatgaaatttaaacaacaatgacaacaacaaaacaatacaatagataaatgaaacaaaaaggtgtttctttgaaaagataaacaaaattgatggaccattagagagattaaccaagacaaaaaaaggaagacccaaataagcttgattaaaaatgaagcgggagatattacaactgacaccagagaaatacaaaacatcattcgaggctactatgaacacctttacatgcacaaactagaaaaccgagagaagatggatgaattcctggaaatatactacactctcagattaaacaaggaagaaatagaaactctgaacagaccaataacaagtagcaaggttaaaacagtaataaacaaaatgccaacaacaacaaaaaaaagtccaggaccagatggattcacagtggaattttatcagacatgcaaatgggaattggtaacaattctactgaaactatttcaaaaaataaaaagagaatccttcctaaatcattttatgaagccaatatcaccctaataccaaaaccaggaaaggaaatcacaaaaacaacaaaaaactacagaccaatactcctgacgaacataaatgcagaaatcttcaacacttatacattgcttgtggtaatgtaaactggtacaaccactatagaaaatagtatggagactccttaaggaactaaaagtagaactatcatttgatccagcaacttcactactggatatctacccagaggaaaagaagtcattatgtgaaaaagacacttgcacatgcatgtttatagtggtacaacacacaattgcaaagatatggaaccagcctaaatgcccatcaaccaatgagtagataaagaaaatttggtatatatagataccatggaatactatacggccataaaaaggaataaaataatggcatttgcagcaatctggataaagttggagatcattatcctaagtgaagtaacacaggaatggaaaaccaaacatggtatgttctcaaaagtggagctaaggaataagaatgcaaaggcataagaatgatataatagactttgggaactcaagggaaaggctgagagaggggtgagggataaaagactgcacattgggtacagtgtacactgctcaggtgatgagtgtaccaaaatctcagaaatcaccattaaagaacttacccatgtaactaaacatctcctgttccccaaaactattgaaatactgaaagaaagaaagaaagaaagaaagagagagagagagagagagagagaaagaaagaaagaaagaaagaaagaaagaaagaaagaaagaaagaaagaaagaaaaagaaagaaggaaggaaagaaattctttaataagactttgatatggtttggctgtgtccccacccaaaatcttatcttgatttgtaatctcccaaatctccatgatccccatgtgtcaagggtggaaacaggtggagttacttggatcatggagagggttttgcacatcctgttcttgtgataatgagtgggtctcaaaagatctgatggttttataagcatctggcatttctcccacttgcaatcacttcgtcctgccaccctatgaagaaggtgcctgcttcacctttgccttccatcatgactgtaagtttcttgaatcctccccacccatgtggaactgtgagtcaattaaacctttttcctttacaaattaccgagtcttgattatttcttcacagcagtgtgagaacggactaataaattggtaccacagattgaggtactgctataaagatacccgaaaatgtggaagtgactttggaactaggtaaaggcagatattggaacagtttggaggggttagaagacaggaagtcgtgggaaactttggaacttcctagagacttgttgaatggctttgaccaaaatgctgatagtgatatggacaataaagtccaggctggggtggtctcagatggagataaggaacttggaactgaaataaaggtgactcttgctatgctttagcaaagagactggtagtattttacccgtgccctagagatctgtggaactgtgagcctgagagagatgatttagggtatctggtggaagaaatttctatgcagtaaagcatttaagatgtgacttggctgctcttagaagcattcagttttatgcattcacaaagatggtttgaaatttggaacttacgtttaaaagagaagtagagaataaaagtttggaaaatttgcagccttaggacgtgatagaaaagcctattttctgaggagaaattcaagctggctgcagaaattttcataagtaacaaggagccaaatgttagtcaccaagacaatggagaaaatgtctctcgggcatgtcaaaggtcttcacagcagcctctgtcatcacaagcctggaggcctagaaggaaaaaactgtttcatgggttgggggccttgctgctttgtgcagtcttgggacttgatgccctgcatctcagctgcttcagctgcagttatggctaaaaggggccaaggtacagcttaggccattgtttcagagggtacaaaccccaagtcttgtcagcttccatgtggtgttgagcctgtgggtgcacagaagtcaagaattgagatgtaggaacctccacctagataccagaggatgtatggaaacacctagatgtccaggcagacatttgctgcaaaagtagagtcctcatggagaacccctgctagggtagtacagaaggaaaatgtggggttggaacccccacacagaatccccactggggcactgcctagtggagctgtgagaagagggccatcatcctccagaccccagaatggtagatccactgacagcttgcaccgtgtgccttgaaaagctgcagacactcaatgccagctgatgaaagcagcagagaggggacctgtaccctgcaaagccacaggaacagagctgcccgaggctgtgggagcccatctcttgcatcaatgtgacctggatgtgagacgtgagacatggaatcaaaggagatcattctggaacttttgttttgttttgagatggagtctcggagtctcgctctgttgcccaggctggagtgcagtgggacagtctcggctcactgcaacctctgcctcccaggttcaagcgattctcctccctcaacctcctaagtagctgggattacaggcacgtgccaccatgcccagataatttttgtatttttagtagagacaggttttcaccatgttggtcaggctggtgtcaaactcctgacctcatgatccgcccacctcagcctcccaaagtgctgggattacaggcgtgagccaccacgcccagcccattatggaactttaaggtttaatgattgtcctattcaattttggacttgcatggggcctgcaacccttctgttttggccaatgtccgtcatttggagtgggtgtatttgcccagtgcctgtaccctactgtatataggaagtacctaacttgatttgattttatagactcataggcagaagggacttgccttgtctcagatgagactttggacttcgacttttgggttaatgctggaatgagttaagaatttgggggactgttggaaaagcattattgtgttttgaaatgtgagggcatgagatttagtgggggtcaggggcggaatgatatggtttgactgtgtcctcacccaaaatctcatcttgaatcataattctcataatccgtatatgtcaagggcaggacccagtggaggtaactggggcatgtgggtggtatcccctgcactcactccatcctgccgccctatgaagaagatgcctgcttctcctttgccttctgccatgattgtaagtttcccacatcctccccagccacacataaccatgagtcaattaaacttctttcctgttataaattacctagtttcagatatttcttcatagcagtgtgagaatggactaatacagactttaagaagcataaactatagaaagaaaaattattgagtttgcatcagtatcaaagatttctgaataacaagaacgatcaatacagttaacagatgagtgaccctctggagaaagatacttatggcatctaaaagggacaaatggttaataaacaatatacgagcaattcctttttttaaaaaaaaagcttttggatgaacaagtgtgtaaattcacattattttttgagtaaggacaaagaaaatgagacaagattttgcttatggaaaaaaaatgcccactatagtcctattaattataaattgtgtagaaaattattattcaaggatgtaacttattacctaattttagcagaaaaaataaatcagggatttccataggcctatcaaaatatggtgcaactttctataatgatctaataaaatttgtgtataagtttcttgtggatataatctatatctattcaacattctcatccattctttgtctaacatactgcatcaggcacttataaaaatagaacaaacgttttcttaataaataatagacctcaatcataaagtccagaaaacatacactcattcaacaaatgttgattaaactatatgttccaaacattgtgctatgtactagatgtagactgcacaaatataagcataatgctgttttcatgaaacatacaggttaatggagacaaaaaagcacagtgatgataaatgatatgtggcataaataatagaattctatgataattaataactattactgagataatattgtcattgaaaagggttttcatcttctctcaggagttgtcattaaaaaaggagtcagtcctccaggagctggttatttgaaaagatcaacaaaactgatagactgctagccagacgaataaagaggaaaagagagaagaatcaaatagatgcaataaaaaaatggcaaaggggatatcaccactgatcccacagaaatacaaactaccatcagagaatactgtaaacacctctatgcaaataaactagaaaatctagaagaaatggataaattcctggacacatacaccctcccaagactaaaccagaaagaagttgaatctctgaatagaccaataacaggctctgaaattgaggcaataattaatagcctaccaaccaaccaaagtccaggaccagacggattgacagccgcattctaccagaggtacaaagaggaactggtaccattccttctgaaactattccaatcaatagaaaaagagggaatcctccctaactcattttatggggccagcatcatcctgataccaaagcctggcagagacacagcaacaaaaaagataattttagaccaatatccctgacgaatatcgatgtgaaaatcctcaataaactactggcaaaccgaatctagcagcacatcaaaaagcttatccaccacaatcaagtcggcttcatccctgggatgcaaggctggttcaacatacacgaatcaataaatgtaatccatcacataaacagaaccaatgacaaaaaccacatgattatctcaatagatgcagaaaaggccttcgacaaaattcaacaccccttcatgctaaaaactctcaataaactaggtattgatgggccgtatatcaaaataataagagctatttacgacaaacccacagccaatatcatactgaatgggcaaaaactggaagcattccctttgaaaactggcacaagacagggatgccctctctcaccactcctattcaacatagtgttggaagttctggccagggtaatcagacaagagaaagaaagaaagggtattcagttaggaaaagaggaagtcaaattgtctctctttgcagatgacatgattgtatatttagaaaaccccatcgtctcagcccaaaatcactgtcagctcataagcaacttcaggaaagtttcggatacaaaatcaacgtgcaaaaatcacaaccattcctatacaccaataacagacaaacagagagccaaatcatgagtgaacacccattcacaattgatacaaagagaataaaatacctaggaatccaacttacaagggaagtgaaggacctcttcaaggagaactacaaaccactgctcaacaaaataaaagaggacacaaacaaatggaagaacattccatgctcatggataggaagaatcaatatcgtggaaatggccatactgcccaaggtaatttatagattcaatgccatccccatcaagctaccaatgacttgcttcacaggattggaaaaaacgactttaaagttcatatggcacatgtatacatatgtaacaaacctgtacgttgtgcacatgtaccctagaacttaaagtataataaatatatatatatatataaaataaataaagttcatatggaaccaaaaaagagcccccatagacaagacaatactaagcaaaaaggacaaagctggaggcatcatgctacctgacttcgaactatactacaaggctacagtaaccaaaacagcatggtactgctaccaaaacagagatatagaccaatggaacagaacagagccctcagaaataacaccacacatctacagccatctgatcttcgacaaacctgacaaaaacaagaaatggggaaaggattccctatttaataaatggtgctgggaaaactggctagccatatgtagaaagctgaaactggatcccttccttacaccttatacaaaaatgaattcaagatggattaaagacttaaatgttagacctaaaaccataaaaaccctagaagaaaacctaggcaatactgttcaggacataggcatgggcaaggacttcatgactaaaacaccaaaagcaatggcaacaaaagccaaaataggtaaatggtatctaaataaactaaagagcttctgtatggcaaaagaaactaccatcagagtgaacaggcaatctgcaggatgggagaaaatttttgcaatctacccgtctgacaaagggctaatacccagaatctacaaagtactcaacaaatttacatgaaaaaaaacaaacaaccccatcaacaagtgggcgaaggatatgaacagacacttctcaaaagaagacatttgtgcagtaaacagacacacaaaaaaatgctcatcatcactgggtcatcagagaaatgcaaatcaaaaccacaatgagatacgatctcgcaccagttagaatggtgatcattaaaaagtcaggaaacaacagatgctggagaggatgtggagaaacaggaacacttttacactgttggtgggactgtaaaatagttcaaccattgtggaagacagtgtggtgattccttaaggatctagaactagaaataccatttgacccagccatcccattactggctatattcccaaaggattataaatcatgctactataaagacacatgcacacatatgtttaattgtgccactattcacaatagcaaagacttggaaccaacccaaatgtccatcaatgatagactggattaagaaaatgtggcacatatacaccacggaatactatgcagccctaaaaaacgatgagtccatgtcctttgcagagacatgaatgaagctgaaaaccatcattctgagcaaactatcgcaagaacagaaaaccaaacaccgcatgttctcactctcagatgggaattgaacaatgagaacacttggacacagggtggggaacatcacacgctggggcctgtccgggggtggggggctgggggagggatagcattaggagaaatacctaatgtaaacgacgagttgatgggtgcagcaaagcaacatggcacatatacacctatgcatcaaacctgcatgtggtgcacatgtaccctagaacttaaagtataatgataaataaatagataataaaaaataaaaaaggtgttagtcatgggtgccagactacagcaaacaaggagaatcacttaaggggttagataagattctgtttttcactctttaaaaagaattgtaatttttaatttttatggatacatagtaaatatacatatttattggggtacatgatatattttgatacagggtaaatgaggcagccatcacctcaagcatttatcctttgtgttacaaacaatccaattattctcttttagttattttaaaatgtataacaaattattgtagactgtagtcacctattatgctgtcaaataccacatcttgttcattctatctaactatatttttgtaccatcaacatccccactgccccctgccgactacccttctcagcctgcggtaacaatcattcaactccctatctccacgagttcaattgttttaatttttaacttccactatactacacaaatgggtgggagcatgcagcttgtttttctgtgcctggcttatttcacttaaaataatgttccccagttacattcatgttgttacaaatgagaggatcttattcttttttatggctgtctattacttcatttcatttatttcattggaagttcatttatttctgctctgacgtttattatttcttttctatacttctgggtttgctctcacttttctattaattttttgtttgttttttgttagctgatgtatttatcattatactttaagttctgggatacattttctattatagttctttaaggtgcaccattaggttgtttatttaaagtttctactttttcatgtaggcacttattgctacaaactttcttcttagtactgctttatctgtatcccataggtttttgtatgttgtgtttccattttcatttaagaaatgtttaaatttccttcttaatttcttcattgacttgctggtccatcgggagtatgttgtttaatttgcatgtgtttgaatagtttccaaagttatcattattgatttctagttttattccactgttgtcagaggagatacttgatattatttcaatttatttgaaatttttatgacttgctttgtggcctaatatatggtctatccttgggaatgatccatgtgttgaggagaagaatatggattctgcagctgttctgtaaatatttatcagatgcatttggtttatagtgcagattaagtctgatgtttctttgctgattttcggtcttgatgatatagctaatgctgaaagagggctgttaaactctccagctattattgtattgtattggagtctctttctctttagttctactaatatttgctttatatatctgggtgctccagtgttaggtgcatatttatttacaattgttatagcctctggttgaattgacacatctatcatcatatagtgaccttctttgtctacttttacagtttttgtcttgaaatctagtttgtctcatataagtatagcttctcctgctcttttttggtttcagtttgcatgagatacctttttgttttcagcctacctgtgtccttatagatgacgtgtatttcttataggcaacagatcctttggtcttgtttatttatccattcagccactctatgtcttttgattggagagtttagtccatttacattcagtgttattgataaataaagacttactcctgccattttgttattgctttcttgttttttttttttttggaagatttttagaacataattttaagatattttctaagaaaaatgttctgaaaatgatttctagcttacatgttccatacctgaaagaaagcatagtatgtgtagaaagtatgtgaatggagatggaaagatgcctgcaatactgtccattctttcgtatcacacagtgtttgaaatttataggaatccatgttgttgggagatgctgaaatttgctgccagtaaatacttctcctttagcctgggtatacaggtagcataaaagaacagggaagccaaggattttagaaatcaaacattcagtctcgtatttcctggcttttttttttttttcacaaaagtatatgctgaaattaagaaaatttgttttcctactttctactgaaatatgatctccttgtaacatttggcttcgtgtcgttcctgtatcattctgttggcactgttcatacacttacctgtgtggcacttgtttgtctataaacatgttttttttttccaataggttggaagcttcaataaaggtaaggattggatgccaattctaaaaagatactagctgcctccaatgaaatctggttaagtgcagaataatttctacagaaaacaactcttttatttaaaatgattttttactgttaaaaaatagaaacagtagcctggaaatggagaaaaatctatctctgagtttcactgtaaatactaaaaactcagtaggcttgtttcaagggaatgggaactggaccttttatttgcttttctgttaccatttaggcaaatataaaatttacagctggtctctcttatgctgtcagagcaatttgacttttctttttggatttgacaagagggaatattcttgtcttgaatgccattaatagtaatgtaacaaatgtacatcagctatgaatgaatcccaaatgctttaaataggtctatgtaaagaaatgcataaaacaaaggatgaaaagaaagtgctaccaagggaaggggagctgtagttgtatgctgttacgttctaagcatcagttgatattcggattctgtttcaccaaaaaaacaaaacaaaacaaaacaaaacaaaaaaacaaaaaaaaaaccctaaaacacctattttttgtgtatgaactattaagtgacaatcacctcaagactagcttgctttctttttaacataagaatctaaaatacactaagaatgaaaacttgcaggagtcctttgataaagaaaaattccgtctcttatatcaagtttaatatttctaataagcaggtgccaacatttatctaacatgacattcccattccctgcagtaatacaatgctaattgatcaaagtttacgaacgcaaaatgtattttattaaacatagcatgagagcagaatatgtagagtgtgcttgtgcttgtatttggttgacataacacttaatttttttttcgtctactcagcatgaatgttaaactgttgggaaatatatctagcttaggcagtctatggtcacttttgcaagcagaaaaaaaagcatctcttagttctggcatcaggtggaccagatcccttcatttttacttgtagatattttagacaagttaagcatgtgttagatttaagccactgtctttcaaaataccaacttctttattaaagtcttttattttcacatggcagtccataaacctttctgattttttcaacaggtctttcaagttctattgctgattctaaagaattggattttttaggaggaggaagagtgggagtagctagagacagtgtgttagtgatcaatagccatatgcttagattcatgcagtttatgtttatatcctatttctacctcttgtgatttgtgttaacttgattaatgggtacttttctcttccatcaagttttcttttccataaagagatacaatatcagcacttccctcatgaggtagctgtgaaggtcaaataaggcaacataaatgaagtgtttagtgtggggaatggcaattgtaaatgctttattaaattacctaccatcttgttattactattatcacaagtaaaaagttaaatgtcacataaatggaggctatacttagaatgagtgtgttaagaatgtatagttaccttatatgcatacaatttctactgaataaattaaaaattatttttaagagttagatttaaaataattttcattgataatatgatgtagatttttgtcaaatttaatggtatattagaaacaaatttatttcaaaggttgatttcctgatggaagcagtgtattactacaaatactctcattttctacatattgccattattttaaaataatctagattaattttcaggggtagtaaatgttaccagttgtcatctttccacaaaagcagtcaggtggccgggcgcggtggctcacgcctgtaatcccagcactttgggaggccgaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaatggcgtgaacccggaaggcggagcttgcagtgagcggagatcgcgccacagcactcccgcctgggcgacagaacgagactccgtctcaaaaaaaaaaaaaaaaaaaaaaaaaaaagcagtcaggtttccttttatcttattagcatgacattcaaatcttattttctaatcaaaacattttgggatcaattatgctaacaaaggttaaatggaaatatgaaaagaaaaattagttttttcttgaacacatatttgaattcaattttgaaaaggggacatgggagttatcactatttgaattaggcaatttctattaattttagaaaatacagtactacttgtttgatgggagcaacaaatattttataaagatttaatgtttataaatttataaaattccttacaatagaaaatgattacttttatattcaagcagaatttaccatacaaaaatatacaataaatatgctaagcgcacagctccaatctctcatgacaattccaccaactttcttaaacaaaaaatttcctgttttgttgttgttaatgcactctcacagtagaaaataattttctatttttcattgataatatgatgtcaaggcaaaattaagacacaagtaatgttacttcataaggatttcccaagaatttgtaaattatcacatttggtgctcaacctactagaccataaaatatcaatgttgccaaaataaaatgattacaacgattacaatgacaataaagacaatgacagtgatgataggaattcttacctgtactgagagttttctacatgtcagggactgtgctaaacacatatacatatccctgttccatcattataggaactttataaggtatgtacttttatctatcccattttacagataaggaaattactatagtttgaatggatgtgtctcttccaaaattcatatgttggaacttataccctaacacgatggtattaagatatggggccttctgggaagtgattaagtcatgaggactctcccttcatgaatggcattaatgcctttatgaaagaggcttaagggagctgcctgcgccttctctatcttccactacgtgagcacacagcattagtttcttttgcctgtcttctcttatgccatgtgaggttgcaggacaaggagttatattgtaaggagaggtggacccacaccagataccatgattttggacttctcagtctccagaattctgagaaataaatttctgttgtttataaattacccagtttatgatgttgtattatatagcagcaggaaaggactaagagaaattaaagcttaaagaggtgaatttgactttacccatttagtgtgttgtagaagtggtatttaaaccaaggacggtaaatgtatgagagtccaagcatttaacaaccaatgccttataagcaacagtcaaagttgtgtagaaggatgttcttcagctcttgctaaagaggacaacattcaggtggtacagcacatccttggccatgcttacctcctcaaggaaaaagcaatgagagttgtatgttgtttatctttttcaataaccgaggtcctaacaagggctccaagttaacacctaagggcccctgaggtatgtcatttgactctgttccactcaggcaatcatcaaggcaccaaggaaatgcccactcccagatataggtgactacagcaacttgtctgtcttgaacactggaggaaaggtgaatgcactgtgtcatgcccattactcattcatggttctatatgccatgacacactgattgagatttgctccaatttacagtaatttagtaactgtcatttacctaccagacgaatatgttgattatgtcagtatcacagacccatacaaagaaattgctgtattctatcaatttgaatatgtgtcttttctgaatcactatagctctctcttccctacaatacaatcaatcttgattatacattgccatatagtttttacatgtacttttctcttttaaaaaatatactataattccttgagtttcaggcctgggacctctagatttctttcacattccccacagttctgagcagttgggcccaatagctcagcataattttgcttgatgatcattcttcaagcctgtattttatgcttcatcattcatagccaaggtggaattaatgctttgagttttaatagtaggaatgaatgtattcatatgtatatttctttttactcaacctgccttgagacaacaactcccacttttcagatgctggccaggaggtggaatgtactttcttataatagaacacagtaaagtccacccaccttcagaaattcaatcccttgatcaggatgtaaaagtagctattatgtgtttggcgctgtaatcggtactaaagtttataagagagaagatagatgctgttagaaatctgaaatctcattggagagctctgtagcactttaaaacaaacaaattacccacactgtagcagaaaacatatgtaaaagctgtaggatacattataaacatgccaacatggagtaatataagacgatatgtacctacttaactatttctgtgagacactacagtcaaagcttgcagctttgcccctaaacacatcatatttgcttgaaccctttttatcttttctatggtagcttaatcacattagatcggagctgactgctggttgacaaaaagctatgtcccatcttttattcaaaccaagtaacatgatatcccagaattaaaaggtccaaacacttttctgttgctctttttttacgtacatattttcacttttgaaatatatatataactcagtggttgggaaactaaaaccagcagtccaagttcagtctgcttcctgtttctgttaaaaaattaaaaaaagttttattggaatacaaccacacccattcattgatgaagtgttgttactgctttcatgctagacagtattttggagaccacatggtctgcaaagctttaaaatatttatcttgtcctttatttataaagcttgctgacaactttttaaaattaatatttagttcaataaaatgtagtaatgtgtttctcagacatttaccatctatatgtatcaacaaaacatcctgaagattttttttttttttttgaaacgaagtctctctctgtccccccaggctggagtgcagtggcaccgtcttggctcaagcagttctcgtgcctcagccatgtgcaaaaccacactcagctatttttttttcattttattttttttaatagagatggggtttctttttgttggccaggctggtcttgaactcctgacctcaagtgatctgcctgccttggcctaccaatgggctgggattacaggcgtgagccaccacacctgaagaccatttccttgagtatggatagggagtcacaacccccaaatacagtagtcattcagaattgtttgcaatgtgtcattttctatgaagtataaagcatttattctaggttatttatatgctatagaaagattagataaaaacaaccaaaggtggtagctttagcattttcataaccttcatcaagtttacaaatagcaaaatactttatttcctactgtggacgtgtgctgggttagggtctgaggatattgaagtaaataaaatatagtttggtctttaatgttttcacactctagttggaagagagaaaattatagtagaaaacaacatttttagtgtgataaaggccctgtaggaaaacagcatataaatgaggaggtaacccctctgtccaagggaattggggaagatctgcataagacatggtatttgacctgaattccaaatgatggacagtgataatcaggtagggaaggtggtctaggcagagaaaggggcacattcaaaggcagaaactttaaagggtatactttattgtgctcagtgaggctacatttatgacactgttcaaaacattaaatatcctgtatgtcataattactgttgataaaatcagaggagagattggagaaagaagaccagtatgtgagggactaagaaaagtgagaattagaaaaagtataatgttggaaaagagataaaggttattaagtagatttcacagaatttcttgacccattgcacatgtaaattagagagagagcaatcaatatttgaggcaattaatttaatacaattgcaaaatggttcaaactgtatgtacaaaaaatggttgcttatgtttacataaaggttcagctgtagaaaatgataataaaaatgaagatacagtcagccctttgtatctctgggttttgccttcacttttttttttttttttctttttgagatggagttttgctcttgtcgcccaggctggagtgcagtggcgcgatctctgctcactgcaacctctgcctcccaggttcaagcgattctcctgcctcagcctcccgagtagctgggattacaggtgcctgccaccacacccagctaatttttattttgtatttttagtagagacggggtttcaccatgttggccaggctggtgtcgaactcctggcctcaggtgatccacccgtctcggcctttcaaagtgctgggattacaggcatgagccaccgcacccagccttgcctccactgctttaatcactgcataacgaaaagatttgagaaccaatcaaaacacaaatttgaacacaatacagtattataactatttgcacagcgcttacatctttttggtattgtaagtattctagagattattcaaaatatatgggaagttgtgcaatgctcacatgcacatgttatgccattgcatatataatggacttaatgatctgtgaactttcttatcgctggatccaatcctctgctgatactgaggaatgactatatgtcaagggaaaaactagaaggaagaaataaagatagcttttatatcaggaacataatgtggttcccattggtactgggaaacttctgtttgtgccccagacacattctcccccaccccccgtttttacatcatactccgccagggaacgctgacatgtatggataatatctgtgggtttaagtgatctttgacacctggtgaggtttggtcaatggatatcctcagagggagagaagagagtgagccacgattcccctgcttcttcccaggtgaagttctagtaggtcagttttctctcttaagagaaggttactgttcctctctcaaagaggctttctctggaagcctctctgcttatgaatagtgaaaaatatccattttttctgcctcttttggccagaggaggtgacagttctgcaattcctagctctgtgtttctgctctttcactttttagcccttttataaacccttgttgaattagcttagtttgaacggatcagctgttactgtcgtaaaatttaagatttcttcatctatttaataataatttattctctacctactttgtgccagtattcttctgggtgttggggagtcagcctggaactcaatgaagtatctgctcccacagagtttatagtccatgaggaaaaagcaaagaagatggaaaggaaactcaggtatttgggcttctttctttccaaagctttaataaaattacagtaaagaaatacaaaagaaacattttataaacaagagagggagagaagactattaggagataagagattccaatgaattttcagaagatagaaatgagatggaagcacaagatgaattatactatacaagagacacagatacaagtttattaatatacataaggcccacacaaacttcttgcagggcctacattatgtgaaacttagcagtgtgatacaatctggactggggatcaccaaccttggcccagggatttccaggagacaaggccacctcaatgcagatgcaacattcataaaccttaaaacaaagcttgcccttaatattcttacctttacctaaagctattcttataacttacactccttttataaaagaaatacctggtaactgacccagactgaatacaggtataaataagggggaagaaatccccaaactttgagaatgatcctcagatggataccttccagtcaactggtcatctgaacccttgactctatctggaccatgacaccagcctgctcccgctgtccatcttgtaagagccctgccagaataaactgcttgagcatcaggcagtgtctaagacatatttgatgcaaatgaaaataaatgggaaaaaattactcctgcagaagctggttaactaggaccatctgagagccctaaacaggacacaaataaaattataactaaacaaaaatacagaaaacatgggccatcaaaaagggtgaaccaataaaaacaaaaacaaacaaacaaacaaacaaacacaaataggcattcctagaagagagaataaaataaatgcaaagaaaacttagaaaataaaaaaaataggttggcaaaaaccaaaatgaagcatgaatccccagacagcccaatggtgacaatgtccttgtgctgagtaagaataaaaatccccacagctcaacatggcatcttaaattttgagaatgccaaggataaaggcaagctctcaaaaacttccaaggaggtgaaatctacagagacagattcctgacaaaggaatgagaattggcctacaatcaattgccctagcattactgcatggttgttgtctaagtcctgtgacagcgactttgaaaataatattgtatatacatttaatctgcctatcaagtgtaaggacaaaatttaggtacattcagaaattcaaaaactgaaaaagttacggctcatgcacctcctctgaagaaattgcttgaatctactacactaagaaactagaggatgaaaaccaagaaacaggaagaaaacaggatttaataaatggaactcatctaggagtcaagtggcaaaaattccaagatgacatctctatggtaggcttagaaagtaataactgcaaattaagttgagagtcaaatgtctctaagattgctttattgaagaaaacaactgtaaggaattccaataatagagtgtaaataaaaagatgtaagttattagtgatgctacaaaacaggctttcccaccaatcttaaaatagaaagagaaaaccagtaaattcaggggtgggggtagcatgatgaaaaataaagtcatggtttaattgtgaaacaaaccaaaacttgtcatgattgactttaatgcaaaagtatccatttgacctgaatcagaagtgctttctgtgaagtgccacaaaaattgtgagatgagacctatgcaaagtagtgtgcaaccttagcacactactttgttgcatagtgaaccatagttagagtcaaattcatctaactacatgttttcaatttaaaaaataagcacagaagcaatacatgggccacttaaatatggttacagaaataaaagtaaatgccattaaccctgacaaattaaaggtaaaggtgagagtaaaaggaagataagatacaagaagtggatggaagtgtaggttcgccaatctcctaccactcatagaagagaatttgaaatcttgacaagtcaggaaataatcatataattccatgtttatgtctgtttttttattccaaaagtaaacaaaaatactaaatcaaaaatattaagtgaaaaatactgttaataacattatctttgtgatttgaagacaattgatattctcttaataaaaaattataataggagatagtttctaatggtaggaattattaatcagtagaagtaaaacaagaaatagttaaaacagttaaatgtgtcagatgctagtaggtggagatagagactggggagagggatagaggaaagccaaatggaattattatcttgtgcatttattactttgatatttttaaaaaatagaatactatttaatacgctgttgtatgtagcctattaggcaaaactgaatttgtactatatgtgaccctctgtattttaaggatatctcaaccaattatatttttgtacaaataaaattacaggaggaatcatcatgctaaaactctaacatgatttaattcaaaagaaataagattaatccccaaaatgtgttttgacaagtagagaatatttaaaaatacaaactactttgcactaatgaaaattattgagtaggaaaataaaataatgatgagaaacaggagaggtgatggggcttcaataaaaaggtattactcagatgagtaaaccgtgttcatttgatttccatcttttcctaaaagtttggaagtttaaagcagagtctttcccaaatttatattccaattttaggcacacattactgccaatgggtatatgaagacatgctcagcatcactaatcttcagggcaatgtttatcaaaaccacaacctcacaccttttagaatggctattatcaaaaagacaagaaaaacaaatttattttattttattattattatactttaagttttagggtacatgtgcacaatgtgcaggttagcaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgactgtatatctagaaaaccccattgtctcagcccaaaatctccttaagctgataagcaacttcagcaaagtctcaggatacaaaatcaacgtacaaaaatcacaagcattcttatacaccaataacagacaaacagagaaccaaatcatgagtgaactcccattcacaattgcttcaaagagaataaaataccaaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacataattggaaaaaactactttaaagttcatatggaaccaaaaaagagcctccatcgccaaatcaatcctaagccaaaagaacaaagctggaggcatcatgctacctgacttcaaactatactacaaggctacagtaaccaaaacagcatggtactggtaccaaaacagagatatagatcaatagaacagaacagagccctcagaaataacgccgcatatctacacctatctgatctttgacaaacctgagaaaaacaagcaatggggaaaggattccctatttaataaatggtgctgggaaaactggctagccatatgtagaaagctgaaactggatcccttccttacaccttatacaaaaatgaattcaagatggattaaagacttaaacgttagacctaaaaccataaaaaccctagaagaaaacataggcattaccattcaggacataggcatgggaaaaacaaatgttgatgaagatatggagaaaagataatctttgcacattgttggtgataatgtaaatagttacagcctatggaaaacagtttgagttttcctcaaaaaattaaaaatagaattaccatatgattcagtaatttctttcaagggtatatatccaaaggaaataaagtcagtatctcaaaaagacatctgccctcccatatttgttgcaatattattcacaacagcctagatagaggaccagtgtggtgttgatggataaatggatgaagaaatgtttatacatatatatgtgtgtgtgtgtatatatatatatatatatatatacgtgtgtattatacgtgtgtgtatatatatatgtgtctgtatatacattatatattatatataaataaaatttatatatattaaattatataaaattttatatgtatatataaattttaatatatataatttatatataaattatatatatataattatataaattatatatatataatttatatatatataaattatatatatatatatatatatatataaattctgtcacttgcaacaacgtggatgaatctgaaggacattatgctaaattatgctaagtgaaataagccagacacagaaagacaaatactgcatgatttcacttatatgtagaatcaaaaaaagtcaaatgcatggaagcagaaagtacaaaagtggttgtcaaggctttgggaatggggaaatggggagatgttggtcaaagagtaaacactctcagatacaaagtgaataagttctggggatctaaaatatcgcatggtacttatagtcagtaattttgtattgcttacttgcaattggctaagagagtagatcttttttttttttttttttttttttttttttttttgagatggagtttcactctgttgcccaggctggagtacaatggtgcaatctcggctcaccgcaacctccgcctcccgggttcatgcgattctcctgcctcagcctcctgagtagctgggatcacaggcgtgcaccaccatgcctggctaattttgtatttttagtagagatggggtttctgcatggtggtcaggctggtctcgaactccccatctcaaatgatccgcccacctcggcctcctaaagtgctgggattacaggcatgagccaccgtgcccggcccgagagtagatcgtaagtcactttaccacatacacaaacaataacaactaaatgtgatgacagatgtgttaatttggttgtgggaattgttgcaaaatgtatatcaaatcaagtttcatgcattaaatatgaatacctttttgctaattatgcctaaataaagctgggaaaaattggttggtgagtacatgtagttcagctgtatcattttgtgtactttcagtgtacttaaaacacttgaacattaaaaataaaataatgggcttggtgcggtggctcacgcctataatcccagcaatttgggaggccgaggcgggcagatcacctgaggttgggagtttgagatcagcctgaccaacatggagaaaccctgtctctactaaaactacaaaattagccgggtgtggtggcacatgcctgtaatctcagctactcgggaggctgaggcagaagaattgcttgaacccgggaggcggaggttgcagtgagccaaggtcgtgccattgcactccagcctgggcaacaagagtgaaactccatctcaaaaaataaaaaataaaataaaataataggcatgccccataaatggtgggcaaacgacatgaacagacacttttcaaaagaatacatacatgtggcaacaatcataggtaaaaaaatctcaacatcattgatcattagaaaagtgaaaatcaaaaccacaataagataccatctcacaccagtcagaacggccattacaaaaaagccaaaaaataacaaatgatggcaaggttgtagaagaaaaaggaacgcttatatattgttggtgggggtgtaaattagttcaattgttgtggaagacagtgtggagatgccccaaagacttaaagacagtaataccattgacacatatatcccatcactgggtatatacccaaaggaatataaatcattctgttataaagacacacagatgcatatgttcattgcagccctattcaccatactagacacatggaatcaacccaaatccccatcaatgatagactaaagaaaatgtggtacgtatacaccatggaatactatgtagccagaaaaaagaacaagatcatgtctttgtaggaacatgtatggagctcgaggccattatccttagcaaactaatgcaggaacagaaacccaaataccgcatgttctcacttgtaagtggaactaaatgatgagaacacacgattacatagatgggaacaatgtacaccggtgcctatcggtgggtggaaggtgggaggagtgagaggaccaggaataataactaaaggatactaggcttaatacctgggtgatgaaataaactgtacaacaaatgcccatggcacaagttttcctgggtaaaaaacctttacttgtatccccgaacttacaataagttttttaaaagggctgtgatgcattcttcagcatgccaattgcatttttcagctccagaatttgtgcatgacactttgtaattatttccatctctgttaaatttatctgatggaattctgaattccttttctgtgtcatcttcaatttcttttagtttccccaacatagctattttgaatactgtatctgaaaagtctcatatctctgttactccaggattaatctctggttccttgtttagttcattttttgagatcttgttttccttcatggtcttgatacttgtaaatgttcttctgtgcctgggcattgaagagttatgtatttactgtagtctttgaagtctggccttgtttgtactcatccttcttgcgaaggctttcaaatattcaaaatatggtagatgttgttacctaaagtttatctgttttaggggcatgccaagcccagtaatgctgtggttcttgcagactcctagtggtagcaccttaatggtcttggacaaaattggggaggattttctggattaccaggcatagacacttattctcttcccttactttgtcccagacagagtctctctctgtgttcttaggcccttggagcttcagattgagtgacacaaccatgcctgtggccaccatcactaggattgtgctgggtcagacctgaaaccagcacggcactgggtctgctgtaaccactccctggctaccacctatgttttctcaaggccctgagcctctactgttagcaactggcaaagccagccaggcctgtgtccttccccttagggcatcaggtttccctcagctctgggcaggtctagaggtcctatccaggagctaggcactagagtcagaaaccttagaagtctacccattgttctgttgtattgtggatcacctggcattcaaaccacaagatgcggactttcctactctctcctgccctttctgaagtcaagggagcctgatcccaaagccaacaccatcataggcccatggggagtactgccaatattcctgaagtccaaagggctcttcggtcggcatgtagtggtgaatattgcctgaggttggattcacccttcaggacaatgtgctcctctctggccaagggcaggtccacaaatgccttccaagagccaagtcatagaatcagggactccaggagcccacttggtcctctatgcgcctgtggctgagttggtatctaaggtgcaagccaaagtctcctttacttttccctctgcttttctgaagcagaaggagtctcaccttttatccagcactgctgagaatatgttaaatctcatctgaaactagcaagtctgagagtctcacacaaagcccttgatgtagtacctgggtattgctgctgctgggtattcaaggaccaaaggcacttcagttagcatttgatgtatgctgccaggactgtctttcccttcaaggcaataggttgccacctggcctggggtgtgtctagaaatttcctctgggggctatggcctggaaagggggcctcatgactccgataggttccctatcctcctgtggctgagctggtttccaagatgtaagacaaagtcctccccactctttcctctcctctcctctcctctccttaagtggaaggaatgagtctcttttggagtcaagagctgtgcagaaggagtctaggggtaggggataggtgatgccagcaagcccttagcaatccaggctggtgtctcagcaggtcatattccctcctagtcctctggctctgggggccagttcagcactaggactcgtctagaagttgcagtccttgtggcacagattgactttcaactttatttataggtccagagcgctttagcccatggtggcaagtcttgcaggaactcaagttccaacttcttggatcagtgcttcccctaaaaagggctgttttaaatgctccctttgtggatgggcatcagctgagcttggactgattttgctttctgctataacagggcagcactgagttcaatgcctcacaattgctgcactctccctctcaccagtgcacagaaatgccctccacgccacacggctacagcagggggttggaagaggggtggcattggcaattcaagaccgcttttcctacctcttcagtgcctctttcattgattttaataagactaggtactgtgagtgctcacctgatttttggttcttttgttttttatttttagggcctgcatggttcccttatgatttttcgttcttatgagtgtgatttttttgtgtgtagatggttgttaaactggtttccttgaaggggatggggataaccagggtaagtcttctattttgccatcttgctaaactacagctcttaatggattaaatgataatatttccttacatagccagagattttagaattttgagtgatttatgatgttacattaacattactgtatctgtatctctcattttctctgttattttcaatacaggctatgatatttgtttgtaagttcttatacaaattcatgagggtttgtcaataaatccagtagctctgattacaataaattatttccaataagctgtaaatactcactggaaaaaaatacctagtagggtttaactgtgaatatgatagtgaacattagggcccctcagataataagcatggcacccactaggtagttttgtttttattctctcccacctcccaccctccaccctcatataggccctggtgtctgctgttcccttctctgtgaccatctgtactcgatattttgttcccacttataagaaagaacatgtgatatctgattttctgctcctttattagttttttaggataatggcctccagctccatttatgttgctacaaaggacatgatcttattctttcttatggccgcatagtactccacagtgtatatgcacattttctttatttagtctattgttgggcatttagtttaattccatgtctttcctattaagtttagcccaagttcttcaccactgcctttatcattgcccttttcacaactcaaactttgaatatttcttgtctggtgagactgaaatagcctctgaagctgcttcttgtctctagttttacagcactgacattaatcctcctattgctctctgtaagacatctgatggtgtcaccttctgccacaaattatttgacgattcctattctgattatctattgctttttaaaaaaatactgcaatatctggcagcttaaagccattttagttgctcacgattttgtgggtaaggaatttagaaaacgctcaattgggtggttcatctctggtacactgatgtattggcagcagctggggcagctggggctgcaggctccatttccaagatgtctttttaaataatgtttgacctttcagtgtttcttgctctgcttgcctttctctgtctgtttctatgcctccgactctctctccatggcatatcaactttcagtactctctacatatcttgggttttttacagcatggcggtctcatggtgggcatagttattacaagacaccgacatttcaagagtaaagagtccaaaagacaaaaagtgtatggttttagaatcttaaaaccagggcccacaaactggaacagtatcactgctaccatatactattgctaaaagcagtcacagtgctttccttatttcaaggggatgctagacctcaaatctttacgggagaaatttccaataatgtgtggcaatctttaatccaacacaactttctaatgctttcaatataaagttcattctccacacactattcatcattgggccattgcctatctttccagcatcaattcatgcaacatccatcaaactaatcttcactggtctccacaaacacacacatatattccaataatagtctctctaatgctccaggttctcccagcctttcatatgtatttagacttctatgttccactgaagacaacaaagagctaataatcactccatcaccagagtcaatgttgttgaggaatgaactatattcaattttaactttagaactatgtagaaacgaaatgaaatttccaaatgaaagcacttttaaatcagaaaagtttaagatataaatatcagcatccaaaatagcaacgtgttccagctatttcatagacttttaaaagacatagacttttaaaagctcatatcttttatgtacaggtaggatgtctttttggtgtcatttttacagttagtatgaacatgtgcatcttccaaatacacagccatgcagtgtcagagcaagtcaccataaaacgtcaccaagcagcagcagcagaaagagagagacctctgaatttaaagtatgccttttggccgggtgcagtggctcacgcctggaatcccagcactttgggaggccgaggtgggcggatcgcgaggtcaggagatcgagaccatgctggctaacacagtgaaaccccatctctactaaaaacacacacacacacaaaattagccgggcatggtggcgggtgcctgtagtcccagctactcgggaggctgaggcaggagaatggtgtgaacccgggaggcagagcttgcagtgagctgagatcgcgccactgcactccagccctgggtgacagagcgagactccgtctcaaaaaataaataaataaaaaaaataaagtatgcctttcatgagctacaaagatgatgagtttgtacaacactttatgctctgttatcacgtaaattttagccttcccaaatatgaaaacctgccatggaatcttcaatattatgtatacaaatactagcccatacactacaccttatttgcctttatcatggtctacattgaaagagagtaaaaagtctcctatacaaccctaacatgtataagaataacttgatggtagaataaaaagttcctgaagactataaaaacttatggtgtagatttatgatttcatatgaatcctcatgcactcctaagggacattaaccagaacaacaaaaaccttttctgtttatgagatttcatgtttcaaagattctatctcaaggaatttctctctgctgtgaaaatacctatacagtcacacatatacactactgaatagcaaatacctacatgccgattatgcagacaaatctgaactcgatttgtccccaagatgtcccaaacactcttctcagggtatctgactccaatgaaataggactgtgtctcaaattcagattttgaaaggtatcttctttaattatcttcacaacttcaggcatagataatacaactaattttaaaaatacaagtcaatattcgtggaatcagaatgtcaaaaatccttagcactgacctaatacgcctcataacttttgcaaagattactgaattcttccatccactcaataaaaaggagaatcaggatagtgatctattttaatgtgctctcctgatgcataagaaggttggtgaactacaccttttacaattatcaagccctgcagtcagaacaagttcgaatccaacttttactgcttattggctaagtaaaagcatgtaagattttgaaattctctttatcatggtctctcaactataaaacatagatcataatattatgtcaggattaaattatgtgtgtcttcatcatcatgctattcagaatagcaaaaacatgaaaccaacctaggtgcccatcaatcatagactggataaagaaaatgtggtggccaggcacggtggcccatccctgtaatcccagcactttgggatgccaaggcgggtggatcacgaggtcaggagttcaagaccagcctgaccaacatggtgaaaccccgtctctactaaaaatgtaaaaattagtccggtgtggtggcacacacctgtaatcccagctactcaggaggctgaggcagaatggtgtgaacccaggaggtggaggttgcagtgagccaagattgcaccactgtactctagcctgagtgacagagagagactctgtctcaaaaaaacaaaaaaacaaaaaaacaaaaaaaaattggtaaataaatatacaacatggaatactatgcagccagaaaaaaaaatgaaatcatgtcctcttcgacaacatagatagagctggaggtcataatcctaagtgaattaatgcaggaacaggaaaccaaatgccacatgttcctacttataggtggcagctaaacattgtgtacacatggacattaacatgggaataatagacactgttgatactagagagaggaggcaggcaggggaacatgggttgaaaaactccctattgggtattatgctcactaccagggtccaatacacccactgaataatgctacacatctatcgctagtatctaaaaagctgaaacttaaaaagtaattagtgtattcattgtctagtgactctcaaccaacagtaacttttttattaataatctttatttggtggttatattttttcagactccatttattgtgtctaatctgaattttctcagaaaacactaagataatttattttaaaaatgtgtagccttattatataaatgatacaatatacatgtttctaatatcttaatttttctgtaggcatggcaggaacaatatccactctgaatatgatatgatatgactataagatgatataaagcacaaaaacctatgctcacaataaactagtatgttttgcttttccaaagtaggtttcttttgattctcactcccaacatgaaacaaattttattattactactttatagatgaagaagcagcctcataaatgtcgagactcagtcatgatctgatagctagtatcaaaaataattcagttgttccagttcatgctcattctattctgcctttctgtttttgtctcttccagcacaattagctatatggtcactcaccattcctgctctctttccacaagataagagtttttgtggggagaaggctgttaaacaagggattacaatttgtaccctccttatcatgagaggccacgtgccttgttctgccttgctaaatgttaataatgtaatgtgtatccctcttgagaaaagggaaactagagacttcttgatgctgctagtcttcaccagcagctttgaggccttgttaaggaaggcagcgttatgaaacagatgagtaaaaactccattaacagactgcatgaagccagaatgaacgctatactcactacttgaattctagttgagaccatatgttctatgtccatactttaaagggtatacagtttgtgaagagttagaaaaccagggaattccaaaaggtaagtactataacatgtaattgaacacagatgaacatagaaggagcacagataatgatggtgaactctaactcggagtctagaaaaggctatataatgtaaaagatatttaaagtgatccttaagaaataatcagactttgccagttagagaaagaaacagacattcagtgaaagaatactctctcctgtgccagcagactaaatgaactctccaatgatgtgatagtcttatttttagtattgtcttctatttgaacactattccagttatctactgatgtgtgaagaaaacacaactgccaaatccagcggcttaaaaaataatcattaattagttcatgactctacaatttaagcagagcttgatgaagaaggctgagttctgctctgtgtggcagtagcagagggggcttaaccaatgggtagtagagtgaaagaatcatttaatatggcttacttacagggattacaagtttgtactggctgttgacttggttcacagcctgggatgaagactttgatttctcatcacatgggcctttccatgtcccctatgatttctcagagcataattctctctaaggccaagggtaccaagagagagaaataggtgggttgtatcatcttttatgacctatcctggaaagtcagagtgccgcttttgccatagtcttttagtttggatagttacaaaggcccatacaaattcaagagaaggggacataaactgcatgtctggagagatgagtgtaaaggtgctagaaaatataatctgatagaaacaccacagaatgagaaaaatctaaggatgaaaagatgagttagtatctacctgaaaaatctattctaatcccaagatgtcatgccaaattcacaaaagaaagcttaggttgtgcttctacttgactgttcagaatttcaagtttgtttcatattacctttcacataaagtgcttgaggttgacaatatctgatatagcactggaagctattgatctaggctttccagtttgatttgaagtgtggccagctgcattgagaaagttgtggttgatggttctcagtttccaagaggacaaagtaaatataatcgcttaacagatgtgtcatgttacatttgagagaattatagagtgaggcagttataagactgttggatagcttactaaaatgggatcacttcagacaccttcaagaaaatgtataatctcgtttgctgaattgtttcaactctaatctaaattagaatcaaatagcggattcaatgactttgatcttcttagagattcatcttttacactttgattggttaagttttatgtgcacactccacattctatagatttaaggtttaacatgacctactctcctgcctccagggtgtatagtttaggaacagcaggaaaccatataattgtaagataatgtgataagcattatagcatagaaatgaacactgttaaaggaaatggaaaaaaagaaaaggcagtaagctctggagttttagaaaaggccccaaaagaaagacatttaacgtgaccctttaagaataaatggaatttttcaggtagagaagagatatgaaaacttagtatagcagcagacatatgacacaagctctgtgctgcatttgaatttgtgtgataaccagctaaacataaggtaattttattttttatttatgtatacatttaaaataataatgaatctattacatgttaacataaacatatctctatgaaaaaactgctatatctctaagacaaaatggaattagtaacattgttttccatattttcaaatttcttaatcatctggcttaattgaagacaaacagatactcatctctgcttctgtacctaattcattgcaatgtgctgcttcggttgagttctgtgaagaaaatacatatcctcacacagtagtttcagtacaggaatttttttttgttttttgttttttaaccttttatttatctattaaattgtattctttatttcaatagttttgggggtacaggtggtttttgttacatggattagttctatagtggtgaaccgagattttagtgcactcattgcctgagtagtgtacactgtacccaatatgtagtcttttatcccttacctccttcccaatctcccctaccctgtctccaaagtccattagatccctctgtatgtcttcgtttcctcacacctcagctcccacttatatgtgagaacatacaatatttggtttctcatgcctgtaacttccttagaataatgggctacagctccatccaagttgttgcaaaagatattattttattcctttttatggctgagtagtagtttccttggtacctatataccacatttttttaatctactcgttggtcgatagacacttaggttggttctatatctttgcaattgtgaattgtgtttctataaacatgtgtgtgcaggtgtctttttcatataatgacttctttcagaaaagtattttaatgatgttttcagatagttttggaaattatttgacactgcactaaaactcagcaagtggtagtttcttaggtttagttgcaatgtaaaattggaaaccatattgacattaaacatttttatgattttaatgattaaaataatcaaaatccactagtctatcttgcatggcttaatttttattgtatatattacaggtgtacaacatgatgctctgatatacatattgaaatgtatacataatgaaatgacatatactataatcaagcaaattaacatatccataactttatacagttacctatttttagtagtaagagcacctaaaatctatgccattagcaaaatttcagtatacctttttttagtacagttcttatgaaatggcatactggtatatgaaaattgattcatcaagtaaatgcaaataaaaaacacaatgagatatcaacccacacctgttagaatggctaaaatcagacagaaaaaaaaatatgtgttggtggagatatggagaaaaggaaacccttgtatactgtttgtggtgatgcaagtaggtacagaaattatggaaaacagtatgaaggaaggttctctgaaaattaaatatagaaataccacatcacccagaaatccctcttctgggtatatatctaaatgaaaggaagtcagcacctcatagagataactgtgctcatgataatttcagcattattcaaaatagccaagataaagaaacaacttaagtgtccatcgatgtataaatggacaaagaaactgtggtgtgtgtgtatatgtatacatataaatgtataataaaatattatttagccttaaggagatactgccatttgtgacaacatggatgagcctaggaatcattatactccgtaaaataagtgagacacagaaaaatactgcatcatgccacttatatgtgaaatctaaaagttgaaggaatagaaagaaagtagaaccgttgttacagggacagggagggggagaaaatggggatatgtaggccatatggaacaaacttgcagttatataggatgactaagtctagagggctaatgtatagcatgaagcagttttattattatcattatttattaaatagcaaaaaagaatccttagccatgagattctggaataccaacagctttccagcacagagaccttgttttatatgagtcctctctgttgtcttttacataaaaggaagtaaatgccgcgtggtgaaatcaatgatggtcaggaggaaatgcaggttcacaactttaagtgaactgaactgtggaaatgaaatttcatcaggtggccagagaaaaaaagcggagccatgaagagagagatacttttcagtccctgacaacgtgttatcaaaagaaaacacattgtcaatcatgttgtcaggaacaaaacttctagacaaaggaaaaatgtacagagaagtaaatgcatattgactggaactcatcctcagacatgtgtaacagacacacagattgacatgtgtaagacacatagatctatatatacaagcagttattggttaacatttattttctcttagatgtttaaaaatgggaaacagatgatacctgatgaagttctcactacggtgttaaaattgtgtaatgtaaagaataaaagcacatggctcagactaatagttctaaaatttgaaagggtatcagaataccctggaaagcttgttaaaacgaagactctgggtctcactcctggagtttctattcagcaggtctggtgtgaaacccaagaatgtgcatttttttttaaagttcccaggaagtgttgatgctgcctgaattgtaatcctaaattggaatcttgcctctatcacttaacagttattaatctttgggaaagttaacttctctctgtctcattttctcatttgtaaactagagatataacacagtgttgaggggctccacccatatactcccagcactcacctttccaattcatgctgctggagtcccactgcaaaaacctgccactgtccgcctaaggacctatgttaggtgcatccacagggctgaccgaaagtgctagcaagttagtgtgcaaagagaagccctcagccaatgagggagagaagctagaaaataatgctgctgcctgctgtctctcaggtgggaggagtcttaggcatgttctcaccagtggttctcaaaatgtggtctccagaccatcacctaggaactcgttagaaaaattgcaaattctttgaacctaagatacattgactcagactctgaggatgagccccagaaatagagtttaacaaactctccaggtgattctgatacacaacaaagttaagaaccactgctctataccatctcccagagaataccagcaggattgagtccaagatgccctgagcagcaacctgcttattaaaatatcctgtattctctttcattcctttacaacctaacctctccaagtctcttattggtactttctagtgttgcctcacttacacaaacacacacaaataataaaacgcacatactcaaatcctcaactcagtctctgcttctgtgggaatctattctataagaaaagatattaacagtgcccatgtgtcatagggaaatgatgaaaactacatgttataattcacaaaagggcttcaaacagtccctggcacatgtttagatggtaaagaaaagttacatttgtgattattattattattaatggaaatattaatgtacaaatgtaaacaaatttaacatttgaatgttctaaccaaaatgaaaaaaataaaataaacattgttttccatttttgcaagtcagacagcactacaattttataatacaatcttatcaggttctttttccataataattttcacctttcctatgtataaaatctgttgtagttcaattaactctccgtacacttttgtcactgctgacattctgtgacttaataattgttgtcactttaatggggatatccctccttaaacattcatcctgtataaacttgtaaactcaggtccaccacagtgtatttaaaaatgtgtttgaagtgggaagctgtcattccattactgaggtattactaagaaatacagcccagggcaatatctgtggcttcctaatacaactgatatttgggtaatttgacatgattataaatgataattacctggtaagtaagccccatagtagtaatatcttcttttcttacaaaaaagtgctttcttatcagctctggtttgaagttccacacagatgtttttcaaaatggagattcactagtgggaatcgtcttcagcaggggtctagcatctatttaatcaacacagatgattttaaaaatgcgctgaatccacccagtgagcgtatctccagaaatgggtttcagaatttagcagcttaaatactatgggatatactgagtattgaagattttatttaaatttttaaaaatagtacaataaactcatgtatcccttcaacctaagttcatcaaatgttaacattttgtcaaattggcttcatctcctctttattaaatatacacattcacaaacgcaaacacacatacatacacaattgatgttgctgaatatttgagatttaagacatcaggatcgtttacttctaaattcttcaaaatttaacttctaacaatggggcatttttttcctttttgaaacagatattttgtaacagcttttggtattataaaattcataactaaagcacatgcctatgcataaaattagaaataaaactatataaactttaaactgtattattacagaaaatattaggagagttaatataacagaaaaataaaagaagagtcatctacactggatatcaaaatgaagacatcctatagtatgttatcaccatctgtacattttcaaaatactgaatccttaattcctaagaaccacaagagacctggactagctaaagctatcttgaacaagaacaaacgtgaacacatcagattttctgacttcaaataaaattacaaagccttagtagtcacaacagtgtggtaccaaaatgaaaacagatacatagaccaatggaacagaagagctcagaaataaagcccaaaatatatggtcaaataatctgtgacacaggcaccaagaatacgcaatagggaagggatagtctctttcacaaacatttatggaaaaactggatatccacatgcaaaaagaatgaaattagacctttatctcacacaatatacaaaaattaactcaaaatgggttaaatatttaaacctaaggcctgaaactacaaaatgatgagaaaacattgatatatttctgaacaaaacaaaatacaagctttcctgacagtacacaggcattgaaatactggaaattcaggagttaaaatagtgcaaaagtgctttgcattgatttataaaatacagtgtctatactctgacatacgtaaacaagtttccctcctacaggaatatttcagggcattgtaaagttgtgtgtaatggagggataggtctctgctgtttaagactcagtaatgcataacaggatatctaccatagcttgctttgacttctttcatacccagtaatttcctagacaccttgtcaggaattacaactctcactgagattaaatgatttaaacaaagcagagaaaatacgaaacactgtttacaggtataatgcattaatttttgttaatgactattctgatttatttatttatttattttatttatgatggagtcttgctctgtcacccaggctggagtgcagtggtgcgatcttggctcactgcaacctccgcctcctgggttcaagaaaatctcctgtgttcaagcaaatctcctgcctcggcctcccgagtagctgggattacaggcgccccataccatacctggctaatttttgtatttttagtagctatggggtttcaccatgttggccagtctggtattgaactcctgacctcaagtgatccacccgccatggcttcccaaagtgctggggttacaggcatgagccactgtgcctggctttaccttttaattcaacaactgataaacaaaacaaaaattttattcatttgacaaaaaagtaaagcctgacaaactgtcttttcacagttaccataatgcttgtagctataagcacaccttttttctgagattataagtagcagtgatgagcctccacaaggagcattattacaaatgattcaagaaacatagatcctttaagtcatcttgatttatttgctaacatcattccacccatcctgcacctctccacaacaatccctttgcagaatattactataaaatgaaggtagaaatattcctccctttgtgcctaagtaactcccaatgtcaaaataataatgtagtcataaacaaatatgatgcgctatgtatcaaacaactctaggatattaagtcaagtgtatactgaacttaaatactagctatgccgttttaaaaattataaccatgttctcagtgattgtggataatagttcagcacagtgggataaaggcaaataggtcagttacctgaaattaactgtatttaaatgattatgatttaatatactatctcttctcaaaagtacattttacaaaataaccttggggtaatgaaattattctacagtaaataattcattgtttgaaacactaatgtctccctaatatacttttatctagaaatagcaaggaaaacttcgaatagatcatctaagaaagaacattgtaattcaacagagaagagacgggaaatatctaaggcaaggaaggaaaggtaagcaaggcagcctgctcctccaggattgtctaggagctcaaagaggctccccagtgcgaggaaagggtgagagatctgagcagtttatattcccatagtaaactcctgcaatcctagccacaggccagccccttgatcctcatgggccctgaacatagggagctgcctggagatcatgcgaaggcattgctctacacagggagctcatgctaagtcctacacatacccacgggacgcaagcaggtacaacatagtgccattttgagagcctagctcccatcaggtggcatcttgtcctgtggtctaaaagccccttcatcgccacatctctgaagccgccttgatatccctgcccacaactactgctactgctggctattcccactggaactgaagtgtgagcctgtggcagtgtcccggacatgcccagcagtggagctgccacacatttgcatattcccagagtgtagactccccaggcttacaactgctgctgttactggctgctccatctggcagtgatcccactgcccctagcagcagggtttacagtaatttacacacgccctaaggagagactctcctgtccacaggcatgccccaatgctaattgttgctgccagtgagtgctgaaacacacctcactggcagtaaacccaccaccctcacaagcatcaaggctgccaaacatttgcacatgccctgaagacaggctactttgcctgcagccacagccatcaccagacgtggccactgggtgctgaagcagaagccactggaagtgaccccaccaacttcagcagcagggtcactgcacatttgcatgtactctaaggacaggatccccacccacagccactgccactattggctgttgcttccaggtaacccaagcgtaagccactggcagcaaccttgtcaacctcagcagtagagctcacatgcatttacatgtgctttgaggacaggctcccctgcacacagctgtcactggtgctgaactgtgcactgcccagttgcctggctatggctgctgccactgacagcaccgtgctctttccgggaacagggccataatgtacttctgcatgcttgaggagaggttcctctgaccaccaccactcctgccatttccacctgagcactccacaggggtcctgaggacaaccatatttctgtccacgatggccagtggccagatgtaccatcagggagcctaaagacagagttgcccaatttgaccccacccttcccagtggcagattacattatctgggctgggattgcccaactttgtccatcacagttagtacctgagcaccttgcccaggggcctggagatgagcccactaagcctgctattacaagcacatctggcacctatctgcatgtgccaccagtgggtcaagggactaaccagcatagcttgatgcagccactactaacaccagtatggatcccctgagagccagagggttagtccatcatttctattgccattgtacctatcatacccactgcccatggaccgaaggacctacccagcctaccactgccactgctgacacccaagcaaactgcctgcaggccgaagaatcaggctgcctgaacctgctaataccagggctagcatatcccaaacaagagcccaaggacaggcgcgctcggcctgctgctgccaccaatggagcctgagaactggcacacctggtgtctcgattccaggtgaaacttcaccacagcctctttttaaaaccacgcacaaagccactgagaaaatcacagaaaccattgaggccattcacagctaaataaattatatgggaactacactagtgcacacacagagagtcaaagctaaagtgccctaaccaatcaataccataggtatatcttttgtaagatgtcttcccctaacagcaaattcaaaaaattggaagaagcaactgttataccagatgtgcagatatcaatgtaacataaaaaggaaggaaatatgcaacaccaaataaatacgataattctccagcaacagagtccaataagaaaggtacgaaatgcctagaaaatcattcaaaataatgatattaaggaagctcaatgagatgcaagggaacacagataaacaataaaaagaaattttaaaaaattactaatgagatagatatcataaaaacagagccaaacaaaaatcctggaattgaaaaattaattgaataaaaattatacatatatatatatgtttaagagcttcagcaacagactacatgaagcagaagaaagaattttagaatttcaatgtaggtctttggaaataatgtagaaaaaattaaaaaatataattaaaaaatgaacaaagcctacatgacatatgggataccataattttcaaatttttactgtcccagaaggcaaagataatgacaaagggataaaaaacctatttaacaaaacaatcattgaaaacttccaacatttagcatgagatgtagatacacagatacaagaatctcagagatccccatataatacaatgcaaaaaggacttcaacactacacattatagtcaaattgtcacaagtcaaagtcaaagagaattccaaaaacagcaagggaaaagtatctagtcacttataaaggaacactcagactaacagaaaatttctcagcagagatcttataggtcaggagagaatgagataaacaacaacaacaacaaagaaaactatgagttctaataaacaaattcagtaaagttgcaggatacaaaaacaacattcaaaaatcagtgcattcctatatttaaaaaacgaatgaactaaagaagacatccagaaggcaatcacaactacaagagctacaaagaatacctaagaataaaattaatgaaggaaatgaaaggcctcctaaaaaagtaaaaaacctacaaatcgctaatgaatgaaattgaagagaacacaaacaaatggaaagatatcccatgctcatgaataagatgaattagtgtcattaaaatgaccataatgcagaaagaaatctacagatttagtgcaatctctagcaaaataccgatgtcacttttctaaaaaacagaaaacaatcctaaaatttgtctggaagaaaaaagaggctgcatagccaaagcaatcctgagccaaaagaacaaagctagaggtatcaaactacctatgtccaaatatattacaaggctctagtaattaaacagcatattattacttttttatttgaattccttttatttttaaacttataagttcaggggtacatgtgcaggtttgtcacataggtaaatgtgtgtcatgggtgtttgttgtacattatttcattatccagttattaagcttagtacccattagttatttttcctgatcctctcccaccttccaccatccaccctttgataggcttcagtgtgtgttgttcccctctatgtttccatgttttctcatcatttagctaccatttataagtgaaaacatgcagtacttggttttctcttcctgcattagtttgctaaggataatggcatacagctccattcatgtccctgcaaagaacatgatcttgttctttgtatggctgcatagtcttctatggtgtatatatatgcaccacattctcttcatccagtctatcactgatgggcatttaggttgaccccatgtctgctattgcgaatagtgctgcaataaacatacctgtgcatgtgtctttatgataaaacattttatattcctttgggcatatacccagcaatgggaaggctgggttaaatagtatttctgtctttaggacttttaggaatcatcacacagccttctgcaatggatgaactaatttacactcccatcaacagtgtataagcattcctttttctccacaacctcaccagcatatattatttattggctttttaatgatagccattctgagtggtgtgaaatagtatctcattgtggttttgatttgcatgtatctaataatcagtaatgttgagttttttttatgtttgttggctgcatgtaagccttcttttgagaagtgtctattcatgtcatttgaccatttttaatggggtttttttttcttgtaaatttaagttccttgtagatgctaaatattagacctttgtcagttgaatagattgcaaaaattttctcccattccgtaggttgtctgtataccctgttgatagtttattttgctgtgcagaagctctttaactagattccacttgtcaattttttcttttgttgcaattgcttttgttatcttcatcatgaaatgtttgctcatgcatatgtcctgaatggtattgctgaggttgtcttccaggattttttatagtttcaggttttacttttaaatctttaatctatcttgagttagtttttgaatatagtgtaaggaaggagtccagtttcaatcttctgcttatggctacccagttatcccagtaccatttatggcatagggaatcctttccccatggtttgtttttgccaggtttgtcaaagatcagatagttgcaggtgtatggtcttatttctatgttctgtattctgatccattggtctaagtatctgttgttgtaccagtactatgttgttttggttactttagtcctgtattatagtttaatgttgagtagcgtgatgcctccagcttcgttctttttgcataggattgccttggctattcgacttcttttttggttctatattatatttaaaaatttttttctagttctgtgaagaatgtcaatgagagtttaatgggaatagcattgaatctatatattactttggccattattgtcattttaacaatattgattcttcctatttataagcatggaatgtttttccatttgtgtcatctctgatttcttggaggagtgttttctagttctccttgtagagatctttcacctccctagttaactgtattcctaaatattttcttctttttgtggtgattgtgaataggaagagttggtttgtgatttcggtctcggcttaactgccgttggtgtataggaatgctagaaaattttgtacactgattcggtatcctgagactttgctgaagttgcttcttcacttaagcagctttggggctgagactatggagttttctagatatagaataatgtcatctgccaacagagatagtttgaattcctctcttctaatttgaattccctttacttcttcctcttgccctattgtcctgggtataacttccaaaactatgttgaataggagtggtgagagggggcatccttatcttgtgccgattttcaaggggaatgcttccactttttcccattcagtatgtttgctgtgggtttgtcatgtatgtctcttataattttgaggaatattccttcaatatctagtatattgagagtttttgacacgaatgggtattgaattttatcaaaagccttttctggatttattgagataatcatatggttcttgtcttcagttctgtttatgcgatgaatcatatttgttgatttgcatatttggaaccaaccttgcatcccggggatgaagcctacttgatcatggtagataagctttttgatttgctgccggattcactttgccagtattttgtcaaggatttttgcgtcaatgttcatcaagaacattggcctggcactttcttttcttgctgtatttctgccaggatttggtatcagaataatgctgtcctcataaaattagttagggaggagtccctcctcctcaattttttttttacgtagttttagtaggaatggcaccacatctttgtacatctggtaggttgagctgtgaatccatctggtcttgggctttttttggttggtaggctatttattacttcttcgatttcagaactcgtttcttcctggttaagtcttgggaggatgtatgtgttcaggaatttatccatttcttctagattttctagtttatgtgcatagaagtgttcatgatattttctgatggttgtttgtatttctgtggggtcattggtaaagtctcccctgttgtttctgattgtgtttatttgaatctaccctcttttcatctttattagtctatctaatggtctattttattgttttttcaaaaacacagctcctggattcattgatattttgaatttttttgtgtctcaattccttcattttggctctgatttgattatttgttttcttctgctagctttgagatttgtttgctcttggttctctaggcttttttagttgtgatgttaggttgctaacttgagatttttctaactttttgatgtgggtattcagtgctatacattcccctcttaacactgccttagctatgccccagagcttctggtgcattgtatcattgttctcattagtttcaaagaacttcttgatttctgccttaatttcattatttacccaaaagtcactcaggaacgggttattcaatcttcatgtaattgtatggttttgagtgaatttcttagtcttgagttcgagtttgattgcactgtggtctgacagactgttattatttcatttctttcacatttgctgaagagtgttttacttccaattaggtgattgattttagagtaagtgccatgtggggatgagaataatgtatattctgttgttttggggtgaagagttctgtggatatctatcaggtctatttgatccagtgtggagctcaggtcctgaatatctttgttatttttctgtcttgatgatctttctaatattgtcagtggggtgttaaaatttcccactattattgtgtttgaatctaagtctctttgaaagtctctaataacttgctttatgaatctgaatacacctgtgtttggtggatatatatttaagatagttagctcttcttgttgaaatgaagcctttaccattacataatgcccttctgtgtcttttttgatctttgttgttttaaaatctgttttgtcagaaactaggattgcaacctccacctttttttctggtttctatttgcttggtagattttcctccatccctttattttgagcctatgtgtgtcactgcttgtgagaagggtctcttgaagacagcataccaattggtctttttttttttccagcttgccactttgtgtttttaaattaggacattcaacttatttacagttaagggtcagcattaatatgtgtggatttgatcctgtgactatgacattagttgtttattttgcagacttgtttctgtggttgctttatatttccactggtttctgtacttcattgtgtttttgtagtgattggtaaaggtattttctttccatatttagcacttccttcaggagctcctttaaggcaggtctggtggtaacgaatttccttacaatttgctttactaaaaaaaaatcttatttttctttcacttatgaagctcagtttggccagatatgaaattctgggttggaatttctttacttgcagaatgttggatattggcctctgatctcttctggcttgtagggtttcagctgagaggttcgctgttagtctgatgggcttcccttagtaggtgacttggcctttctctctagctgcccttaacatttttcctttcatttttaactttggagaatctgacgattttgtgtcttgaggatgatctcctcatatcttactggggttttctgcatttcctatatttgaatgttggcctttctagctaggtttgggaagttctcacgaatgatatcctgaaatatgttttttttttcaaaattggtttcatgctccccattttttcaggtacaccaatcagtcatagattcggtctttttacatattcctgtatttcctgtatgctctgttcattcttcattcttttttaaaattcttctctgcatgtcttacttcagaaagacagtcttcatgctgtcaggttatttcctctgcttggtctattctgctataaatacttgtgattgcattagaaaattcttctaatgtgttttttagctctatcaggttggttacatttttctctctactggctagtttgcctgtcatctgcagtgtcttatgatttttaacttccttgcactgggttacaacatgctttttcttagatcattgaaattcatttttatccatattctgaattctcctgctgtcatttcatccatctcagcctcagcccagtttgaaacccttgctggagaggtgatgcagtcatttggaggaaagtgggtgctctggctttttgagttttcagcgttcttacaatgattcttgctcatctttgtgggcttatctaccttcaatatttgaggttgctggcctttggctgggtgttttttctttaaagagtctggtcacttcttagggctgctgtggtttggtggggatcaactacaaccctagtcaccttggattttcctgtaactggaggtatccccagtgaagactgtgaaacaacaaagatgacagctttccccttcctctgggagctccatctcagggagttatagacctgctgctgggctggatgcacctataggacgtggctggagaccctggttgggaggtctcatcaagtctggagaaacaggatcgggggcccgcttaaagaagcagtctggccatgcttagctgtcttgtgctggggtaccacttccatccccagttggcttgggctgtccaaagcctggagactgaaatagctaagtcttcccaaaaataaagatggtggcctccccctcctcccgggaactccatcccagggagaattcaaatctctgtgggccagagaacactggtgggtgtggctagagttcctgattgggagatcccacccagtgaggaggaatggatcagggactcacttaaagtagcagtctggccatgttttgccagagaagctctgctgtgctaagggatttcttccattcccagttggtttggactcttcaaagcctgtaggctgggattgctgagttgtccaaagagcaaatatggtgacctgcccctctctccaggaactctgtctcaggtaggcaaaacactgttgccagtggctggctggattttcaagccattgggtcttaacctgtgaggaaccatgggagtgcggcccacagaccaagactgctcagcctctttcgtaggggtatatacagagttgtaactctcgctttgccagagttgcagttgcttttgctgggaagccctgaggaggagtatgtaatgctcttggttctctgtgtatgccttgtggttgctttgtggagactccaagtagctgtgtgtgtcagactgaaggcactggtggagtggattcatgaggggatctcttgacctgagggttgcaaagatccatgagggaagcattgttgatcagggtcgcacattcactcactgcttccctgtgcacagggcattccattggctctgtgttgctcctgggtgggctatcactatgccttgcttttctccattttccatgggtcaagatgtttccttgattagtcccaatgtgtgtacttagatgttttagttgagggtgctctgtttacttgtccctttagttcctctctgtgagactcacacactgtagctacttcttgtcagccatcttggccatgctcccccagcatattattgatacaaaaacagatgcgtggactaatggcataaaatagtgaccccataaatcacatatttgcagtcaaaggatttttgacagaggcaccaagaacatacactggggacaggataccctcttcaagaaatgttgctgaaaaaaaatatccatatgcataagattgaaactggacccatatctccaccataaacaaaaatcaactcaagacttcaacgtaagacccaaaactctaaaatgactagaagaaaacttaagggaaacacttcaggacatggctctaggcaaagacattatagctaaaacctcaaaagcacaggtaacaaaaccaaaaataagaaaaatgagactatactaaaccaaaatgattccgcacaccaaagaagacagtcaacacaataaagggacaaactgttaaatgcaagaaaatattttcagaatatttactcaataagagactattatctcaaatgcacgaggaaataaaaaaactcaacagtaaaataaaaacaaataattccactaaaatgggcaaagacacttatcaaaggaagtcattcaaatgcaaaacaggtacatgaaaaaatgttcaccatcgctaatcatcaggaaagtgcaaatcaaaaccataacgagataccaccttaccccagttagaatggctattactgaaaagaaaaaataacagatgctacctagaatgtggagaaaagggaacccttatacactgttggtgggaatatagattagtacatccactatgggaaacagtatgaagagttctcaaaaaactaaaaatataactaccactttatcgaggaatcccactgagtatttatgcagagtaaaataaatcagtatatcaaagagataacctgcacacctatgtgtgttgcagcactgttcacaatagcaaagatctggaatcaacttcagtgtccatcaacagatgaatggtcaaataaaacgtggcatatatagacaatggaaagctattcaacaataaaaatcaatgacatcaggttatttgtagcaacataaatgaaactggaggtccttatattaagtgaaataagtcaggcacagaaatacaaataccacctgttttcactcatatgtgggagttttaaaagtcgatctcatggcagtatagagctgaaggatagatacaagaagaggggaaatgtgtgtaggtgaagggaagataaagagagggtgatcagtaggtatatagattagaagaaataagttctaatattcagtatcagaggaagatgactatagttaagaacaacgtaccgtatacttcaaaatagctaaaagagaggacttcaaatatccccgacacatagaaatgataaataatacttgcttgagatgatggacactctaaataccaaggtgaacattacacattctatgcatgtaataaaacatcacatctccctcataaatatgtacaaatattacatatcgataaactataaatattaaggcagtaaatgtgaagtacagtattgtaaatgtctatttccatatttagcaatggaaatcacaaggaactgatataatttaaagaggaacctttgttattaaatggtaaagtatgcctctctgacctgatataggtgtgactagataatacaaattgttctatgtaatttacacacgattttaaaaattataaagtagaaatactgatgccaaagtctttgtgaaatgtgttaaagtaaaatagtcagtggtatatttagctactgacctctattctctcctagttattatggcaagatgatgaaatcacaaatgcaagacagacgtttgtccacccaggttagtgtcctggataaaagagaaaacacgcctttgttttatgcccagtagtacacgtggcaatactgagacatattttaacaaaataaaatagtaaaatatatgctctagagcaaacttttgctataagaatacatgagatttacccaaattcctaattcagttttgacatggatattttaaaaagtcatttagcttcaaaatgcgtattaagtctacccaaattatgaaattcctacacatcctgtatctaagagcactaattctgtttttttcactctaaataagctatatctaaagaagatataagcattcaacttatgtatacatcaccaaattcccctgaatgacaccctcaggaaaacaaaacaacccagggaaactattaactaaatgcatgtatggaagtatacataaacatacacgtacatatctatatgtgtacacatcatatatatatatatatatatatatatatatacacatatgtagatatcttctcacaaaaaacacatgttaacttagtctcttatccattttatgaagtggcttccttcggcaatgtcaaatgtgattatattttacgtcatgttaacattggatagtaaattgagtgcaatggctttcagagcgcaggttgtaaaacagctgtcaaatatcaaccagaatcacatttgaatttacaacctagaactgaaaggtcctttcaaccttttgcaccgaatatggaaagaaaaagatttagaatacattttgacttttgagagttgatacatttaataaaggcttgttaaaacaaaatagctgtgaatgaataacatattgcaagccatgactaaaggaacatttgtgaagagtccatttatgcactatgccatttatcactacaaactatgaatatcctggaggtaaaattttccaaaaagtacagtgttttataaaaaagagtattgtttatttaaaaactgtaatttgtaaacacagtcatgtaattattcctggctaaagtattttattttagttgtaaggaaattactatgtttactttaaaaggcttaaaaaatactagctagtggcacagtcttaaaatcataatatttaaatgtaaaaatattataaagcaacatgcaaaatatattatttaaaatatatatctaaagagaatatacaatatatagaagaaaacattaaaacatcaatagactttccatatggaggtgaaattagatggtaatctttattttatttaccatgcttatatgcatttcccaaattttctacagcaagttgctattactttggtaacaaaaaagtaaaatatccatatatctgtgaaattatattttctctctctgaccatgtaaacctatatggatctctctagttggtaataaagccacgaaaattattatggaaaaggagagaacaatcaaaattagatgtgttttccattttgtgtcttatctatggtataggctatcttattgcctctgcattctgaaaaaaaaaaaatagaaaaaagaatgagaggttaaaataacaaacctatttttccttctttccagaactgatttctaatagtgtctttttctatatccaccttaattcttccccttcaaaataatagacagttttcccacctttggatttcttactggtaaattgttgtcttcactcaggccagcaagtgagctttctcacacttcaagagaaagcaaaagcaacatatataaagcaaaagaaaaagtagaaatactgcagaaaggccttttttaatgtgcgaactggaaggctgagttttagcagttttctaaaactggccctagcattcaccattgaattgtggaaagattgcagcaaagctctatgtccaattgaatcaaatcatccagagcagctctgtccaatagaacttgctgtgatgataaagatgttccacagcttctctgtccaataaggttgtctattagacaattgtggctaatgattaaaatgtgactagcattgctgaagaactgaattttaattttatatgattttaattagtttaaacataaattgctacatgtgactagcatatccaaagtattcaacttaacacataatacccttgatcctaaaaaatgaagttgtagggtaaaaaagagtaaataaaatgtcagggtgaattttaatagctttattaagatataatttgtgcatcataaaatcaatttatttaaaatgcataattcaacagttttttagtgtattacagagttgtcaagcattacaaatatctaattttagtttcatcaccctaaaaaactctatatattaatattcatgccccacagcccccgccaattccagcactaggtaacaactaatgtactttcgatcgatatacctttgcctatactggacatttcatatgatatcgtagaacgcgtggtcttttgtgactcctttcacttagaagaatgctttcataattgatctatgttccagtatgtaccagcacttcattattttattgccaaataatatgccattgcatgaatgtagcacatttagccaatctatttgtcagcagatggataaggtggttcttttccacaccaactgatatgaacaatgtttccgtgaagattactgcaaatgttttgtgtgaatatgttttcatttctcttgcatatatacttgtgagtgaaatttctggataatgctcttaactcagtgtttaacatttgagggaccaccaaactatttttcaaagcaactgcactattttatattagcatctgtaatgtataagggtacatatttttccacattctccccaacagttgtttttgtctgccttttattagagctatcctagtgagagtatgaagtggtatttcactgaggttttggtttgcaatttttttttattacaaatgatgttgggcatcttttcatgtacttattgaagcagtttattttggagaaattccttttaaaatccatgactcctttttaattaggtggtttttctttttattattgactcatgagttatttatatattaagaatagataatatataaataacatatatccccttatcagataatatatatccccttatcagatacatattttgcaaatatttttctcattttgtgggtagtctttcactttcctgatttcctatttgcagtagaaaagttttaaattctaatgaagtccaatttatttatttatttttttgtcactcagacttttcttattgtatataaggaaactttgcctaactaaagtcacataaacttagttttgtgtttcactctatgtgttgaagtttaactcttacatttagatctattatttatttgaagttttgcatacagagtgaggtagaaatctaattttattccttttcatgtggattgtcagttttttcagcaccgtttgttgaaaaggttattttccccattgtcttggaacatttgttgaaaatcaacttaacataaatgtaaaggtttatttctagactataaattctactccatcatttatacgactatccttctgccactaccacactctgtgattactttttttttttatttgagacagagtatcgctctgtcgccaggctggagtgcagtggcacgatgtcagctcactgcaacttccacctcccaagttcaaccgattctcctgcctcagcctcccaagtagctgggactacaggcttgcgccaccacgcccagctcatttttgtatttttagtagagatggggtttcaccatgttggccaagctggtcttaaactcctgacctcatgatccgcccacctcggcctcccaaagtgctgggattacaggcgtgagccaccatgcccggcgattactgtaacttcctagtaagttttaaatccaggaactgtgaggcctccaactatattcttccctttcaagattgttttggctattcttggcactttgtacctccatatgagtttcaggatcagtttgttaatttctccaaaaaaaaaaaagtcaactggggttatggtacagaatacatcaaatctatagattaacacgtggagtgttgacatgttaacatcttttaatatgtgaatttctatttatttcaatcttttaaatttaattattaacctgaaaatgaaactaagaaatccatttgcaatagcaccaacaataaaaatactcaggggtagatttaacaaattcactgcaaggcttatatccttaaaatggcaaaccattgctgagtgaaatttaaaatatctatatgggttatgtctgttttgtttctctgtcccttcttcactgtttctttttgataaatgaatattttctattataacattttaattcaagacttttaactgtatacgttgtttcttactgactattctatagcttgaaatatgcatgttaatccctaaatataattaaaactatgttcacataattccagtgagatatagaaactttaccttcatatagctctattttctaccccctatattgtgatattgttatacatattacatcagaacatgtaacaaacctgacaaacttattgttataattgctaccttatataacctatgtctgttaaagatgctgacacaacaatgcacagtacgtatatatttttagagtttactatattaatattcttatttaccatttctggatatcttcctttttcatttttttcctctgttggctcaagtatccatcagttagcatttctctacttcaacaatttttttttctcacctacctcttttgtactttcagtgccacatatattatatttcaattaatgtatgtcaaaacctaataatacacataaagatacaaagatatgtcatgttatgcatttgcttttcagtaagttaaaagaagtaggcatatgcatccatagtatcttttatatttacttatatagttatactctttttttgtgtggattcaaattactgtctgatgtcacttgtctttattctaaagaaactgctttagtatttcttgtaaggcatgtctgataacaataaattctctgttttgtttacttgctatttagccttcattttacatttatttacactttacttttgaaagttagttttgctggatatataattctattttgttctgttttataatttcaaattttattttaaattcaggaggtaaacatataggtttgttacatagatatactttgtgatgctaaggtttggggtacagatctcaggtagtgagcatagtacccagtagtttttcagacattatttccctccttccctcctctctctagcagttcacagtgtctattgtttccatctttatggccacatgtactcaaagtttagctcccatgtataagtgagaacatgtggcatttggttctctgttcctgagttaattcatctacaattatggcttccagctgcatccatgttgccgcaaaggacataatctcattctttttcatggctgcatagtatcccatggtatatatgtaccacatttttttcctgtgaaagcaaccatgtaatagtttatttagtattagacattaattggtatctttgaaaaaaatattttgatttacattttcttctacttttatttcaatttctgggggtacatgtgcagattacttacctggataacttgagtgtcaccgagactgggtgtataaataatcctgtcactcatatagtgagcatagtgcctgataggtagccttccaaaccatgctccctacccccagtctccccacttcaagcagtctccagtgtctattgttcccaactttgtatccaagtgtattcagtatttagctcccaattctaagtgagaacatgtagcgcttggttttctgttcctgtattagtttgcttaggataataaccttcagctgcatctatgttgctgcaaaggacatgattctaacggttgtgtagtattccatggagtatatgtcccacagttttttgtttttttgttgttgttgttgctgttttttgacggagtctcactctgtcacccaggctggagtgcagtggcacgatctcagctcactgcaaccttcgtctcccaggttcaagcggttcttctgccttatcctcctgagtagctgggactacaggtgtgtgccaccacgcccagctaatttttttttttttttttgtagttttagtagaggcgggtttcaccatattggccaggctgttctcgaactcctgacctcatgatccgcctgcctcagcctcccaaagtgctgggattataggcgtgagccaccgtgcctggctgtcccacagtttttttaaaccagtccaccattgatgggaatcttggttgattccaggtccttgctattgtgaatagggctgtgataagcatgcaagggcatgtgtctttttgggagaatttatattcctttagatatatacccagtggtgggattgctgagttgaatggtagctatgttttaagttttttcagagaccttcatactgctttccacagtggctgaactaatttccatccccaccagaagtgcatcagcatttcctttttttctgcaacctcaccttcatctgttgttttttgaccttttaatgacagtcattctgactggtgtgagatggtatgtcattgtggttttgattttcagttctctaatgattagtgatggtgagcattttttcatgtgtttgttgcctgcacatacgtcttcgtttgagaagtgtctgttcatgtactttgcctattcttaacggggttgttttttctttgttgaattgtttaacttacttatagataccagatattagatctttgctggatatgtagtttgtgaatattttctcccattctgtaggttatctttcactctgctgataatttcttttgctgtggcaaagttctttagtttaattaggttctacttgtccatttttgttttagttgcaattgcttttggggacttagtcataaattatttttgaaggttaatgtgtaccacatttttaaaaaaaatctaatgcaccattgatagccttctaggttgattccatgtctttgttatcgtgaatagtgctgcagtgaacatacgagttcatgtgtctttttgggagaatgattcattttcctttgagtatctcactatattctagactcaattgttactaatgagaagccagttaatgttttggctgtaagcttgtacctgatgtgcacttttgttttgctactttcaaaattttcaagattctgactattatgtggccaggtgctaaagtcctttggtttactatacctggagtttatggatcttcttagatgtttggaataatgtttttaatcagctgtgggaagtttaaaccagtatcttcgaatatttttatttttgtgttttcattcatttttatttatgattgacacataataattgtacatatttgcaaggtataatgtgattttttgacacatgtatatattttgtaagatcaattcaaggtaattacagtatcaatcaccttaaaaggtatcatttctttgtgatgagaacatttaaaacccatctactagccattttgaaatatgtaatacattgttgttaactccagtcatcttactatgcggagaacattagaatttatttcttctttccaactgtgcctttgtacctgctgaccaatctcatgccctccccctcctgctcctcttcccagcctctggtctccactattctcctctttacttatatgagaacattttttatattccacatataagtgagaccatgcagtacttgttttctgtgcctggctttttttcacttaccatgatgtcctctaggtttatccatgctgctgcaaataacaggatctcatgctattttatggcttaatagtattccgtgatacatatataccacattttcttattcatttatctgttgacaataaggttgattctatctcttggctattgtgaacagtgacgcagtaaacataggtgtgcatatatctctttgccatgctgatttcatttctattgggtatatatgctgtagtgggatttctgggtcatatggtagttctacttataatgttttgaaaatccttcatactgttttccataatgcctgtactaaattacattcccaccagcagtgtgtaagtgtttccttttctccacatccccaacacttgttgtactttgattttgtgatagtagccattctaccttcactgacataatacctcattgcagtttttggttacatttttctatcaaaatactgatgacattctgcacagaaacagacaaaaaaagtatgtaaccacaaactaccttgaatagccaaaacaatcttgaataaacaccaaagctggaggtatcaaacagcctgaattcaaaacatgctacaaagccatagtaactaaaacagcatggcagtgacataaaaacagacgcatagaccaaaggaacagaatagagaatagagaaatctacacatgtacaaccaactgatttttgacaaagtgctaagtacacagaatggagaaaggaatgtgttctcaataaatggtgctgagaaaaatagatattcacatagagaagaatgaaattatacccatatctctcaccatatagagaaaaataactcaaaatggattaaagacttaaacagaagactcaaactatggaactactagaataaaacacagggtaaaactctatgacattagactaggcaaagatttttttttcgataaaactaaacaagcacaggcaacaaaagcaaatacagacaaatggaattacagcaaactacaaagtttctgcacagcaaaggaaacaatgaacagagcaaagagacaacctacagaatgggagaatatatttgcaaactatatatctgataaggggttaatatccaaaatatgtaaataattcaaatgactcaacaacaacagcctgttatttgcaacaacatggactgtactggagaccattaagtgaaataagccaggcacagaaagacaaacatcctatgttgtcacttatttgtgggatctaaaaatcaaaataattaaactcatggacacagagagtagaaggatggttaccagaggctgggaaaggtagtggggggtttggagggaagtgaggatggttaatggatccaaaaatacagttataaagaatgaataagacatactatttgattgtacaacagggtgactatggtcaataataacttaattgtacattttaacataactaaaggagtgtgattggattgtttgtaacacaaaggataaatgcttgggggcatcgataccccattctgcatgatgtgattatttcacattgcaggcctgtttcaaaacatctcatgtgccccataaatatgtatacctactatgtaccaacaaaaattttaaaaaaatttaaagtgagcaaatgtgaccctattttgctatcaaatagtaggtcttcgttgtacatttaaaaataactaaaggggtatagttggattgttttttaacacagaagataaatgcttcaggggatggataccctactctccatgatgtcaatattatgcattgcatgcctgtgtcaaaatctctcatgtaccccagaaatgtatatatctgctgtgtacccacaaaatgtacaaattacaaataaattgagcaaaagacccgaattgacatttctcaaaagaagacacataaatgggcaacaggtatatgaaaaaatattcaacatttttgaatatcattttgttcctttttctctaccctctttctggttttcccatgagagtcatctatattaaacaggttaaaataatcaaaagcaattggctcacaataaatagagatgagacccgagtgtgataacaagagaggaaactagtcagatgcttaataggaagatcacgaaaagagaaagtacaagaaaacccagctgaaagcaccatcatcactggtggtcaggaagactgtatataaacccaaggctgccacgtctttggatttaaaacatcccaaggtgaatattgcagaaaaaataaacttcactgaatcaatctagccgaatcaccaaacaaatgaacaagtaaacaaacacaatgcactccaaaagagggatagatcagcatgaagagttgctatattatctaaaatctccagttttcaacaaggatttttattatttttttattatactttaagttttagggtacatgtgcacaacgtgcaggtttgttacatatgtatacatgtgccatgttggtgtgctgcacccattaactcgtcatttacattaggtatttttaaatcctcaaattcagaatgaaataaattgacctaggtcacagatctagtgggtaacagagctataatctaacatactggaaagcaagcctcttaaatattaagttcccatttattgtgggtttctatgtgtgagacactgtgctaaatactttatatgcattatattacttcatcttgctctcaacaatcctctgtgatgaaaattattacactcaactttcagataaaaaaatgagatctggaaaaatttacaaccagcccaagtaaatgttggactaaggatttgataagataaatagcaaaacattccctgcttataggctgaggcctcagaatgacagttttatatacatagtctgttttgctacaatggatgttttaacaatgccgattagcttatccacattaggtaaacaaaggaatgatagtagtttaatgttaaagccattttgaatcactagccttatttcctagtaggttaatattttgatgtgactggagcaaaataactttcacaaggctttcataattaatgggaaaactttaggcatatgtgaagaccttaagaaaaacacacttgaaaatcccggaaaaatgtcctccagattaaaaagtggttgatttagtgacttcaagaatcactacactttcagcaatgttaaactatttgaagaaggaccgacaaagagatttctccagtgtcttttttttttcttttgtaaagtgatgtagactactaaacccagagcatagtgttaatttcgatacaactggttacgagtagaaacaaatatactcaaggacctatatcttgaagaaagaagagtgagcctgagagtgtaaggttgaaaaagatgaagggcctgtgacactaggtataaaatacagtggagatgcaacttcattaatggtttactaagatgtattttagaaatgtttttaaattctaaatttctgacacagggttagcattgtttttcttagagtttgggttacagtgttcctgaggttttgagtggcttccctcttactctattttcccagtaaacccctatgcttagtgtgtacttttgcataacaaatgcttttcaataacacagatactatagaagaaatctcacatattaaaactacatcctttaaaattaaattgaattgcttacattaaaactcccatgcttatactggatttacatgtccatatagattagtgtggcaatttttttaaaattagctgacatataatcattaaaaatttggggtagaatgacatttcaatacatgtacaaattctgtaataaattatttagcatacccatcagctcatacatttatcatttctttgtgatgagaatatccaaaatcctattagctatttggatatatgtaatacaatattgttaatcacaattgtcactctaaattgaacagtaactttgtacctattgaccaatctcttcttatcttccctctctcctaccctcctcagcctctggtaactactattctattctctaatatatgagatcaatatctttacatttcacatgagtgagaaaatgtagtatttgtctttctgtgcctggcttatttcacttaaaaataatgtcttccaagatcattcacattgctgcaaaagacaggatataccttttttatggcttaacagtagttcattgtgtatataataccacattttctttatttcattcatccattggtggacacataggttgttgccatttcttggttactgtgaagagttctgcaataaacatgagagtgtaggtatctcctggaaatactgattttattttctttggatatacacccaagagtggaattgctagatcatattggagctctatttttaattttttgaggaaccttcacactatttttcataatagctatactaatctacattcacaataagagtgtataaatatttccctttctccacacccatgtcagcacttgttatttttcatctttttgataagtcattctaattaaggtgaggtgatgactcattgtggttttgatgtatatttccatgatgattagtgaggttgagcatttttcatatactgcttggccacttatatgtctttttttgacaaaaatacctaatgaggacttttgtccattttttgattagataatttttctgctactgagttgtgtgagttccttaaatattctggatgttaacccattgtctgatgcacaccttgcaaatattttctcccattctctaggttgtccctttgctctgttgattgtttcatttgttgtagagaagctttttagattgatgtgattgatgcaatcccatttgcctatatttgctttttgtattgtctgtgcttttgaggtttttttttttttttttttttttttttttttttttttttttgagacggagtctcgtctctcccctaggctggagtggctcgatctcggctcactgcaagctccgcctcccgggttcacgccattctcttgcctcagcctcccgagtagctgggactacaggcgcccgccaccacgcccagctgatttgtggtgtttttagtagagacggggtttcaccgtgttagccaggatggtcttgatctcctgaccttatgatcctcccaccttggcctcgcaaagtgctgggattacaggcgtgagccactgcgcccagccgcttttgaggttttataaaaaaaaaaaaaaaaaaaaaatccttgcctacgccaatgtcatggagcttttacccatgaaattttatccttgtgattttataattttggttgtacacttaagtagttaatttggaaaatttttttgtatatatgtcgaggtagaggtctagcttcattctctgcatgtgaatatgcagtttacctagcatcatttattgaagagattgttctttcactaatgtgtgttcttgtcacctattgcaaaaatttgttggctgtgtgtcagatgcatttgttgcattggtctatgtgtctatttttatgccaacactatgctgtttcagtcactatagctttctagtcaattttgaagacaggtaatgtgatgtctccaactttgttctttttgctcagaattgctttagctattctggctcattcatttgtggttccatgtaaattttagggttgtcatttctgtttctgtgaagaacgtcattggtattttagtatggactgcactgaatctacagatctctttggatagtatgaacatttcaacgatgttaatgattccaatccatgaacacatgatatctttccatttatttgtgtcctcttcaatttttttcatcaatgttttacagttgtcattgtagagatctttcatccctttggttaaaattattcttcggtacttcatttttttttttggtaattattgtaattggaattgtttaatttctttttcaggcattttgctattaaaatgcttctttttgcatgttgattttgtattctgcaaattactgaatttgcttattaattctagcaatttttggtggaatctttagggttttctatatacaagatcatgtcatctgtaaagagggacaatttgagttcatcctttccaatttggatgccctttatttctttttcttgcctaattgttctgggtaagaccaacagtactatgttgaataaaaatgatgaaagtgggcatcctcatatagccaagacaatcctaagcaaaaagaacaaagctggaggcatcacgttactcaacttcaaactatactactggactacagtaaccaaaacagcatgatactggtacaaaaacagacacacagactaatggaacagaatagagaactcagaaataagaccctatacctacaacaatctgaccttcaacaaacctgacaaaaacaagaaatgcaaaatggattccctatttaataaacggtgctggaagaactgactagccatgtgcagagaattgaaactggaccccttccttacaccttacacaaaaatcaactcaagatagattaaagacttaaatgtgaaacccaacactataaaaacccagaagaaaatctaggcaataccattcaggacataggcatgagcaaagatttcatgctgaaaacaccaaaggcaattgcaacaaaagcaaaaattgacaatgggatctaattaaactaaagggcttctgtacagaaaaatagtctattatcagaatgaacagacaacctacagaataggagaaaatttttacaacctattcatctgacaaaggtttagtgtcaagcaactacatgtaacttaaatttacaagaaaaaaacaaacaaccctattaaaaagtgggcaaagggcatgaacagacacttctcaaaagaatatatttatgcagccaacaaacatatgaaaaaaacctcaacatcactgattattagagaaatgcaaatccaaaccacaatgagataccatctcatgacaatcggaagggcaattattaaaaagtcaagaaacaacaaatgctggtaaggttgaggagaaaaaggaacattttacactattggtgggaacataaattagttcaaccattgtggaagacaatgtggtgattcctcaaagatctagaggcagaaataccatttgacctagcaatcccattactgggtatatacccaaaggaatataaatcattctgttataaagatacatgcatgcgtatgttcattgcagcactatttacagtcataaagacatggaatcaaaccaaatgcccatcaatgatagactggataaagaaaatgtggtacatacatacatgccattgaatactatgtagccatgagaaggaaacagatcctgttctttgcaaggacatgaatggagctggaagccattatccttagcaagctaatgcaggaacacaaaagctaacactgcatgttctcacttacatatggaagcttaacaatgagaacacatagacacatggtggggatcaacacacactgggacctgtcacaggggtaagaagaggaagaccatcaagaagaacagctgatgcatgctgggcttaatacctagatgatgggttgatctatgcagcaaatcaccatggcacacatttacctatgtaacaaatctgcccatcctgcacaagtaacccagaacttgaaataaaagttaaaaaaaaaaagaatgtgagcatccttgtcttgtcatatatggatttgtaataatttgtcttatatgacctttactgtgttgaggtatgtttattctacacctagtttgttgacagtttttatcatgaagggatgttatatttcatcaaatgtttttttctgtatctattgaaatgatcatatgccttttgagttgactctgttaatgtgatatcatttattgccttgcatatgttgaaacatccttgcatctctgggaggaatcccacttgataatggtgaatgaccttttagtgtgctgttggattcagtgtactagtattttgttgatgatttttatatctatattcatcagagatattggcctgtagttatctttttttgttatgttcttatctggttctagtatcaaggcaatgtcagacttatagaatgactttgggactattcacttctctttaacttttttgaaatacaactgtccccttgtatatacaaaggattggtttttgaactcttgcatataataaaatttgtacatacccaagtactgcagtcagccctgcaggagctgcatatacaaaaagttggccctccatatatatagatttcacatcccacaaatactgtatttatttgagtttggttttaaaaacccacatataagtggacctacacagtcccaacccatgttgttcaagggttaactgtagtttgaaaataattggaaatagttctttaaatgttccacagaattcagcattgaagacatcaggtcctgagtttttctagaaaacattcatatttactgtttcaatcttgttactcattattggttggatcacactttctatttcttcataactgtggtgggttgtgtgtgtccggcgattcatctgatcttctaagtttcctaatttgttggtgtacagttgttcataatagtcttttatgaccctttgtatttctgtggtgttagttgtaatacctcccgtttcatctctgatttatttggttcttctgttttttcttagactagctaaagtttgtcaattttgtttatctttttaaaaacgaactcttttttaagttgatctttggtattgcttttttagtctctacttcatttatttatgctttgatttgtataaatttttctttcgagtaatattgggtttagcttgttcttgcttttatagtttcttgagaagcaacattgggttgtgatatttctttcttttttaaatcttggtatatattattatacaagtccataactgttttccataagaatgttgtgttttcatttctgtttgtcccaaaatattctttcaattctgtttagtttcttcactgacacaagagcatgttgtttaatttccatgtatttgtattttacttttataggttattattttatttgttaacctttaagtttggggaaaaaaaagtttggggtacgtgtgcaggtttattatataggcaaattgcaagttgtgggggtttggtgtacacattatttcatcacccaggtaataaacacagtacccaaaaggtagtttttcaatcctcaccctcttctgaccctccacccttaagtagggcccagtatccattgttctcttctttgtggccatgtgtgctcaatatttagcactcattcttaagtgacaacatacagtatttgcagtatttgattttccatttctgtgttagttcgcttagcataatggcctgcagttccatctgtgttgctgcaaaggacataatgtcatttctttttatggctgtgcagtatcccatggtgggtatgtaccacattttctttatccagtctacccttgatgggcacttaggtttattccatgctttgctatctattgtgaatagtgcgtgtgcctttatggtagaatgacttatattcctttggttgcatacccaataatggaattgctgggtcgaatggtgtattagtctgttttcatgctgctgataaagacatacctgagactgggcaattttcaaaagaagaggttgaaaggacttacagctccacgtgttttgggaggcttcacaatcatggcagaaggcaaggaggagcaagtcacatcttacatagatggcagcaggcagagatgagagagaccttgcgcagggaaactcctccttataaaaccatcagatctcgagacttattcactatcacgagaatagcacaggaaagacctgcccccgtgactcaattacttcccactggatctctcccacaacacatgggaattaaagataaggtttgggtggggacacagtgaaaccatatcacatggtaactctgttcctagttccttaagaaatcaccaaactgttttccacagtggatgaactaatttatattcccactagcagtttataagcattcccattcctatacaaccttgcctgcatctgcaattttttgactgtttagtaatagccattttgacttgtgtgaaatggtatctcactgtggcttttatttgcatttctctaatgatcagtgatgttcagaattttttcatgtttgttggccacgtgtatgtcttctttgaaaagtgttcatgtcctttgcctactttttaatggggttgtgctttgcttgttaatttgttgaagttccttatagattctggatattatacctttgttggaggcatagtttgcacatattttctcccattgttcaggttgtctgtttactctcttactgtgcagaagcatgccagtttagttagttcctacttatcaatttttgtttttgatgccatgcttatagtgtctttgtcatgaagtcgttactgggtcttaagtccagaatggtatttcctgggttatcttccaaggtttttatagttttcatttttacatttaacttttgaatccatcttgagttgatttttgtatatggtgtaaggaaggggtcgagtttcaaacttctgcatatggctagccagttatgcctgtaccatttattgaatagagagtcctttccccgttgtttttgtcaactttgtcaaagagaagatggttgtaggtgtgtggcattatttctgggctccattttgttttgttgttggtctatgtgtctgtttttgtggcggtatcatattgttttggttactgtagccctgcagtattgtttgaagttggttaatgggatcgctccagctttgtgctttttgcttaggattgtttgggctattctggcccttttttgattccatatgaaatttaaaatagctttttctaattctgtgaaaaatgtcattggtggtttgctaggaataacattgaatctttaaattgctttgaggagtgtggccgttttaacaatattgatccttcctacccatgagtgtggaatatctttccttttgtatcatcactgatttctttccacagtgtttttaaattctgttgtagagatttttcacctctctggttagctgtattcttaggtatttcattgaatttgtgtctattgtcagtgagttcttttcttgatttggctatcagcttggaggtttagtgcgtagaaatgctactgattttatatcctgaaactttgccttaagttgtttatcaggtctaggagcctttgggcagagactacgggcttttctaggtatagaatcatattgtctgtgaagagaatgagtttgtcttcctcttttcctatctggatgctttttatttctttctcttgcctgatttttgggtctaggacttccagtgttatgttgaacagaagtggtaagagtgagcatccttgttttttttcagtgcacacatgtggtggtgggagagggcacacaagttctgcctgcaagtgtgcctacaatgtaatggggaaagcttccagcttttgtctaattagtataatactggctgtgtgtttgttatagatggctcttattatttttatgtatgctccttttatgcaatgtttgttaagtttttaacatcaagggaggtagaattttaccgaaagtgtttgctgcctctattcagaggatcatgtggtttttatttctagctctgtttataagataaattatatttattgatttgcatatgttgaaccaccactgcaacccagggataaagcctacttgattgtgatggattacctttttaatatgccgctggatttggtttgctagtattttgttgaagacttgtgaatctatgttaatcaaggatattggcctgaagggtggtttcatttgctgtgtctctgccaggttttagtatcaggatgatgctggcctcctagaatgagttaggaaggagtccctcctccccaattttttgtaatagtttcagtagaaattgcaccaactcttatttatacgtctggtagaatttggctgtttctgtttggtcctttgttggtaggctttttattactgattcaattttgaaagtcaatatcggtctattcagtgattcagtttctttctgtctcagtctttggaggctatatattcccaggaatttatccatttcttctaggttttctagcttatgtgcatagaggtgttcatagtagtcacggaggctttctgtatttctactgtgtttctgatcgtgtttattgggattttctctctttttttgtctagctagcaatctaccttatttattctttctgaaaacaaactcatggactcaatctttagtatgatttttcatgactcaattttctttacttcagctctgattttggatatttgttttctgttggctttggggtttctttgctgttgtttttctcattcctctaggtgtaatgttaggttgttattttgaggtttttctaacttttgaagtaggtattagtgctatatttctttcttaacactactttagctgtgtcccagagattctggtatattgtatccttgttctcattagttccaaataatttcttgatttctgccctaatttcactgttcacccaaaagtcattcaggattaggttgtttaattcccatgtgattgtatgattctgagagattttcttagtattgatttttattttattacaatgtagtctgtgagggtggtttgtatcactgcagtttttttttaatttgctgaggattgtctaatgttcagttttgtagttgattttagagtgtgtgccacgttcaggtgagaagaatgtatattctgttgttttaaggtggagagttctatacatgtctactaggcccatttggtgaagtgctgagtttaggccctgaatatttttgttagttttctgtctcagttttctgtctaacactgtcattgtgctgttgaagacttcacctcttattgtgtggttaactaagtctcttcataggtgtctgaaaacttgctttatgaatcccgatgcacctgtgttgggtgcattttagtatagttagatattcttgcttaactgcattctttatcgttaatgccatgctcttctttgcctttttaaatcattgtttaaagtcatactgtatgaaattagaatggcaatccctgtttttttttttctgttttttgtttgcttggtagatttttctccatccctctactttgaatttatgggtgtcccaatatgtgagatgggtccctggaagacaccatacagttggttcttgcttctttactttccactctgtgccttttaactgggggcatttagcccatttacattcaaggttaatattgatatgtgtagatttgatcttttcattgtgttgttagctgattattaagcaggcttatttgtttggctgctttatagtgtcaatgatctatgttcttcagtgtgtttttgtagtgccaataatagtcttcctttccatatttagcactctcttcaagacctcttgtaaggcaagtctggtggtaacaaattcccttagcgtttgcttgtccgaaaaggatcttatttcccaatcacttacaaagtttagtttagctggatatgaaattgttggttggaatttcctttctttgagaatgctgaatttaggcccccagtctcttccagattctaggatttctgctgagatgtccactattagcctgatggggttctttctgtaggtgaaccctacagaaattgaatctttaaattgctttcaagcaatttatagccattcatgttagccaggatggtctcgatctcctgacctcatgatccgcccgcctcggcctccaaaagtgctgggattacaggcgtgagccactgtgcccggccttttttttttttttttactatttctatctttctctttctttctctctttgactccctctttgtctctctgcctctttctcttctctgtctctctcctctctgccccttctctctagctgcctttaacattttttttctttcattttaaccaaggagaatgcgatgactatattttcttgagatggttgttttgtatatcaatagtatctggcaagggttctctgcatttcctaaatttgaatgttgacctctctagcaagataggggaaatttttatgggtgatatcctgaaatatgtttttcaagttgattgttttctctttcagagatgccactctgacgtagatttggtctctttagataatcccatatttcttagaggtttcgttcagtcttctttaatctttttttctttatttttgtctgaatgagttattttagagaatcagccttcaaggtctgagattctttcctcagcttggttgattctcttaattttattggttgatgatgagagtgggtcattccttgccgtttcactcacccctgccccaggagtcactagcaggcaggaacaaatcccagtgcttggtagccctgtgcagggtttgcagcttcctccccattcagcccagcatctgtgtcctgcctctatccactttcaattttataattcgttgattctcataattttattcggaaatttttgaagtaagattttcagctctttcacatcagtttgattctttcctaaaatggccattttgtcttttatctcctgtattattttgttcaattatttcttagaataattgaattgagtttcaactttctcctgaatctcgatgatctttgttccatattctgatagaattccatattctgaattctatttctaccatgtcagccatttcagcctggttagaaaccactgcttgggaactagtgcagttgtttggaggtaagcagatactctgttgttttgagttgccagagttcttgtgctggttctatctcatctctgtgggatgatgttccttcaatctttgaatttgatgtcctttggacgagtcttttttcttcttttgccttttctgatgccctttggggtttcattttggtataaggtgtattcagttgactggctgcctttctggaagatttcagggggacaaggcttggtttagcactcctgggctgcctgctctaacactgaggggttgatgttgggctcccagctttgttctctggccccttgaggttagaagcatgctatgctggcggggctgagatgttcccggactgttcactgcagcagtcagatgtttggtgtcatccaaagtgcttcattgaggcagtggcagtgggttccattctattttgcatgtcccaacagcagccacatggcagggtgcaagtgtggtgtctggggcagggtactggtgggagcaagtctgtgccattcctgtgcacttgcataccagcagtggttgggggagcagggggctgttgggcatggggctgctggcctccatgcatgtatttcagcaaaagtagtggtggttcagtggggctgatgctgtcagtctccagtgcacatctacagtcatggtggccatgcagcaggtgcaaggttgtcagcatctgtgtgtatatttgtgcaggcaatgaccacgcagcccaggggacaggatgcgctcatgctggcatcagtggtgagacagtgttcgagtgcacacatgtggtggtggaagagggcatgcaagttctgcctgtgagtgtgcctacaatgagaggggggtgtaaggaaaagtggttcagtggaggctgggggaatggtaggggtgggctagtatgcattaacagggccactgtactggaggtctgacaggtacattttgctcttgaagaagctatgagggcccccaggaagcaccccagttgagtatccaagactgtattgtaagtgggcactgccaggctggggccctaggggaggccagcagatgggggttctcagatcagactgccccttttcaagggcaagactgccctgctctgtacacgtccaacagccccctaaagagtaaagtctcctagaacagcatagtgacacatggggaatgggcatccctggtcatgctccactgaaggcatttctgcaccaaactctctggaccctgcagagtctggagtctttcccctacgacatctctaaggagctccctggaagctcaagtatctgtgggggtcatggggtctcctggtgccaagatttcagttgctcatgatgagagtgggtcattccttgccgtttcactcacccctgccccaggagtcactagcaggcaggaacaagtcccagtgcttggtagccctgtgcagggtttgcagcttcctccccattcagcccagcatctgtgtcctgcctctatccactttcaatgccttccctccaaatatctgctctgagtgtgtcagtcttcccaacatcccagtctctcatggacagatgtttctcctggctgcatgtagtcagccatcttcaatcccgcctccacgtttacttttaaaagttgctaaatttatcccgttattgatttctagttttatagcattacagtcagaaaaagatacttgattttgaatttgatctccttaaattagttaagacttcttttgtggcctgtcatacaatctatcctggagaatcttctatgtgcagttatgaagaatgcatagtctatagctgttgaatggaatattctgtaaccatctcttaggttaggtatatttggtgaagagtgcagtttaaattcaatgtttctttgttgattttctctcttatttgtccattgttgaaattgggctgttgaggtacactactatagtgcagtctatcttttcctttggatgtattaatatttgctttatacattaaagtgctctaatgttgagtacatatttaaaattgttcattattttgctgaattgaaccctttattacgatataatgaccttctttatcactttttaccatttgtgacttaatctattttatctgatataatgtagttattactgctttcttttggtttccatttgcatgaaatgtatttttatagtctttcaatttcagtctatgggtgtccttacaggtgaagtgagtcacaggcagcatatagttagggtttttaagaaaattttattaagccactttatgtatttttaactgggtaatccatttgcattaatggtgatatttgataaggaaggacttactaatgccactttgtgaactgctttctagttgttttattgatcttcctttttttcttctcctacgttcttctctggtggctaagtgattttttctctaggaatattttgatttcttgctttttgtttagtgtatctaacatagctttttgctttgtgttaaacagaagaattataaaaaacatgttataattatatgggttattttaaattgataaatttgttcacaaaaaaaagaaaataaaaatacaggaaaaatctaccatttagtttatcttcccccaattcttaatgtttaatatcacaatttacatttttatattgtatttttcttaatgaattagagttatctatgttcttaatagttttgcctttttaccttcgtactaaagatgtgatttgtacaccaccattacattattagagtatccagaatttgattgtgtaatttattttttccagtgagttatatactttcagatgtttctggtgtacttattactgtccttttatttcatcttgaagaattccctttagcatttcatgtaagataattgtggtggtaaataatttcctcgcctttcattggggaaattgactggtgagaactgtaagcccattaccacttcagctgtgacagctctaaagggaaatgtaatcccaggaccaccacagtcggaatcctttggcctccaagggtaacacagtgctggattgcacctaaagccaatgaccacctagacctgtgcagcactgggacatgcccaaggcctactgctgctatggcttgcctaccactgagggttattcagggctggaggctgctgtagttacctggtggtaatgtgggctggatcttgaattcttcttgccagggccactggtttcattatggcccagggctgggcctagaggcttcatctttggccacggggttctgctcagtactcagctttactgaggtgggccccaggcctgtgttgtgaggcaaagtgttatgcttgcttttctctcctctcttcaagtcaaaggtgtctatttatgtgctgttcttcctggagtttggggatagtcaacatagttaataccatggccaccaacgctgatgtaatgttgggtctcatccaaaacccactgccactgagagctgtgcagcactggggcatgtctaaggcccgcaggtgctatggctgccactgaggtttcttcggggcttgaggtaactgcagttggtcagtgatgatgcaggcaagaacaagagtctatatagccagggttacaggttcttttctgatgccagggagggtctagaagctccatttgcaggtatcagcctggcgtcaggagcctaagggttctgcccagtaccgtgtttaactgtgttgggctcagtactttgttccaaaccaaggtcctctttcttcccccaagcagatattgactctctcttcactctgctgctgtgggttggtgaaagagtgattccggtaatgtaaacctgtccttgtaggttcttcagtgcttcttttcttcttattattatgctacaaccaggaacattgccattgatatattcttgaaaattgccactttaagagaaaagacgtacagcaggttctggaataacattgtttcattcaacattattttgctataacactgatgaagaaaaaaaaatggatttcctgaattcttatgaaggttttctggtgcgtggatagttgttcagattgatgtttctttgggggaacaatccctggagaagtttacttcaccatcttgtccagctttttggtataggaattattaaagattgaataataagtgtgtaaaaatccataacaaatatagattagcataaataaaaaaatacggagtttgaagttttagcttccatagaagagctattatcaatttctattaaattatcacccagtctgaaatgaagttttgagttaccgttggtaaatggcttgcctattccaataagtatttgcattttggaaacaggttataacaaaaagtaactcatgcacagtttgtctaccagcccatctgggaatttagaagtttatttctcattactgccaaggttggtattcaaagctggtaataaatgaagaaacagtggacatcaggctcagaaagattcactcctgaaattaagtagttatctggacaaagagaatgtatttcatttgttgctttctttgcttttttctattttacaaactatactaggagatcagatggatctttaaatagataaggtttaatggtcataaaaagggcaaacttagctaccattttacctgctggctgcttacctttttaaaaatcagctaagtggatagcattaggagaaatacctaaggtagatgatgggttgatgggttgatgggtgcagcaaaccaccatggcacatgtatacctatgtaacaaacctgcacattcggcacatgtatcccggaacttaaataaaaaaaaaaaaagaagtgtaggctcatttcaagatacatttctcctaattgcatttcggaggaaatgtttttcagagcagctcttttagagaaggccaaagtccaagtataggaaatcttaaatgcacttagatgatcctcattgcttcttagaatggaaaaataaatatgactgattgattaagggaagaatttggctttccttcaaggaataagtaggtagtaaaaaaaatcagctaagtgtgatatttttccatttaaaatcatttatgaaactgattttatagtaaactgttattattttgttattttatagtaaactgttattattttattaaagaaaaaaataatgtcaggttagtaaataatagaatcatatataatatatctaagaggaatgatcaataatttaaataactgtgtgaacaaaactcaatgccctttaaagagaatgactctccacaatgtatcactcataatgtccattgtccaactacaaattgttgtctaggcataaaaatagtagaaaaatgtgttccataatcaaggtgagaatatcaatatttgaaaagtgattatcataccctaacttgaatctgtgttttatgaggatgttactgtggcatttttctcagtgggaatcttaagcctttaaagactgccaaaaataggttgctatgttgacttcacacttctgattttctaatctggtacaagtttcccaacaggttcaatttaattgtaatcatatatctatgactcagttgtatgttcactaatacctatatagcatctaatatcatctactatctgtatatactagttctcatttaattaacttatgcttcttccttattagttttttattgctagtcttaaaatttactagttttccattatcatcttctctgatatgctgtcccttggcccaaatttgaagagcccacgaactataacaactttctattctgttttccaagactttatttactataaactctttatgccgaggaacatttactatatccagcactttaatgtctatagacagaactccagcaatcagacagcaagcctaaaatctatgtaataatactgtcacacttgttttgattctgttattcctatagctgtgtgaaagaatgttctgtttttttctgtagtaaataagtataattattttagttatacatatttagaacgaaaacatcagatacaattcaaatttcttagattgaggaatacatatttctattatctaaaataaatcaagttttcaaatttcagatgctccccaaatgctatatgctaccacaataacacctagctaattatcacactatatctttgaccgtgccatttccaagttattgctccttggttttctaaaaatttcaaagcccaacttaaattttatctccccttggaagctttcccttctaataaatacttctatctgcttattttctctccatccatacaacaataaacttcatatttttttcataaacaactatgctcacaattatgtacataaaatgcgagcaaattaatatatgaagactttcagcaattggacaaaatgtgaaaatgcagatattttcagatttccttgtgttctgtgagtagtaaaggaagttgtgcctagtgtctctccccctccccacccccacacacagataagaaagaatgtcattaaattaagtcgtggcaaaaacaaaatctatgcttaatagcattctaattgatctcatgaacgtttaaaatttctaaataaaagaatgaaaactaagtctttaaaaatattttgctatctttagtatctcctatagttacctacttttaacattgtaacattatctttattcctcttcccctttacctctacttattttccagttcttttcacctttttataatcaaaggcgaatttaaaagttcaaaactataataatgagatgggtaaggcaaatcataatttatttcaataaattgtcaaagtagaacagctttgtaaccccaatgatttgctttttgcagagaagctaaaggctagctttacagtaataagattgatagaactttctaaagactgataaaattgaaagcttcgtgatcactctttcttcaactatttcttctcagccgacgatatttttttcctctaatatctgatctgctgcatcttggtattctatctaggtttcaaatgcttttcactgtgagtcaattttattcagtgttcaggattctcttatctgctgcttaaaaggtaacttatttagttgcatttttttcctagaagaagcatatcaataaaggggagaatattgttttttcagtttccccctgggaagataaaactcagtaatctttttgcatagcagagataaaaacagacaaatgtagtcaagcccacacaatacacaagagaattcaatttgatgtcccatgaggcccatggaaagtaaatgcatgcattctctccgctcaacaatttagatccaatcaagacgaattgcacatttacatgaaaattcatggtagaaaaaacaggatatttacttttacttttcagatgcttttgatgcagcaataacaggaatattagtgataatgcatttcaaaatataactcatttaacaaatccttactgtaacacagaggcctctcaaaggagaaactgcaggtcttgaataacaaaattgagtcatgcctttcatgctgaactcctatgttctttaaagtgcacagcccatcattaacattcaatattaaataaccatgagtaccagttcacatctaacagtactcctttctccatcgaccttcatccatccacatgttaaactctagcaggatcatcaatttaactggagaaaaaccgacctttcatgtttcttttattctacttgggtaaaatctgaaaaatattcatctcttttgcaagctttcttcagggcttcctttccataaattaccataaaagccaaacctggatgaatcaataggctttacccaacatatcagatgtgctgaaacagagacaggtaaaaaattatcacaagtcatcaataataaattagtttgtctgcagtagtgatatcaggccaatgtgaggaaggacttactcctgagctattaatcctatcataagaaaattccagtgatgaaagatacaatttaagaacaaaaatgtgttcgtcaaattattttcctcttactttcatcaagtcaattaactgaaaaaaatactttaaattctttcttccactcaactgttttaggtacttctgccaaaaaataggaccacagtgtgctatacagtctcctataggaaattaatcagagattctgtgaacccacagaagtgacactgaaattagagtagatttgagatttcaaaaggaatcaatgtagtaggaaaacagcgggtggcaaattgatttcaaaatagcaaaacaagctgtaggaatctgtgagtcagaaatggatatttaaaatatattattttgaagtaattataatagcctgtagactattagtaaaaccattttacattctaatcactaacaatgtcataatttcttaattaaatataatacatataaagtctatatcatgagaaactatagttttctcattgccagaaacaatcaatccatgtctaaagaagtacctttagtttgtattcgttgccattttaaaagtgtggatagaatgatgagtacactatgaatatcacaagagcagttgaagaggcaagcattaaaagatggacagaaaaatctcaaacattgggagaatagttatatgttgctactgaatgtagaaaggggattatgaggacaacactaagggtgggagtggattacaatgtgtataagaaagaattccatcacagagagtactgccttccacaatgccatggtctgccttctaatcttccaaattccatctctctgaagttgttccatcagaagcaagacatctgcaaaacttactatggatgagtatccctttctctgtatagaactcactaaatgacttcagtatcatgtcagaaacagatatttcaactctacactctgtcatttttctattctacttctaatcaactgtaaacaaaatgggcataactaagagaacattttctagagatgtttataaagttttgttttgaagttagaaaataatttactttgaatttaactttagcgataattcgtgatcattttttcactaccctcttcaacttctgtcaacaacacattagactagcccacagttcctaaatcagtatttgtcaattctctctctttattaggaaaggtagaaaaataataggttacaaaataaaaagagttacctattcctctagtcatttacttcggcagcaatttcaatgtcttgtcagtacctatgaacaaaatagaaggctcaaggtgtagctacttaatctgctccttctgcactaaggcagaaatggctagcttcaccattgcagactctgaagaaagtaaagtttatagcctcactttaccaaatattaaccatttagtggctttccttggctttaattctggatcaagttcttgagtactgtactttgtgtactgtgcactgaatgaataactttgcatttgtatttacgttattttcatttggtaatccaatctatctggaattacaatgtctttgataagaataatatatttttaaaagaggtcatacatctttgctaaaatgtacttttggaaaatacatggcctctccctgccagcagtcactttgggttaaaaactaaaaatcaaatctcttacttatgagtcatggtttcaaaagaccttcctttgtcatttgcaagttaaacaaatatgaatattacacagtttttttttttaccattgattcagattataatttatagctatagtacctgccagaatatctcttagcttcctcttagcaactcttcccttttctaatctatctccctctgtactgtagccagggtgatattttcaaatttgagcatctaatcaactgaagctctttcttgcttaaaatgttttaatgtctttgaatccctcaaagaacccacacaaccatatctgttttcgcctacccctccagtctcatctcacatctccctctcttctcttgccatattgctatcagtttctatttccgccaaccattagctatcatttgaaaccctcctcctatgatatccttctccctctctactatacacacaaaaatactttatctttcagataacttccttggggtgaggggatctatgctgacttcagtttatgtcaatttatttttgttaagggctctcaaaaaataatgttttctttcttttgaagttcttatcttgaatgttatttgtgtattcaatagtggaattgtttaattgatgcccatttcatatactagcaaagcttcttcactgtgacattgctagcatttgggctgagtagtattttatgatggaggctgtcttgtgcactatagtatatttagcagcatttttagcctctgtccaccagattctagtaccacacttccctccccaccacaactagagtgtgacaaccgtaaatgtctccagatacattcgcatatattgcaccagggtacagttaccaaaccattaactctatgaatgtagtgacctattttttgctcattattttattcctatgcctaagatagtgctgagttttagtgggtacttaataaatatgtttaaatgataaatgttgagtcatgaagtttttttatagcagaatttgaaaacataccttgtcaaaatgtgagagccatgaaaaatgcatctagccatttattttaaaagctttcaaaaaaaagctttcaaatgctaagagaattgcatactactgtctatacaaaaaggaaaagttaatctaactatgcttcaagcattttttcaaaaagcaaaacatttaaaacattgtgatgtaggaatatgtgaaaaatctaccatttaataaagttaccctctttcaaattactttaccactacttaaaggaggacgtatagagttgttcatgttgataaaggtaaaatattatacttgcctccgcatatttccttagctcaatctgattttaaagtaataagctgaaacttattttctacatgactgaatacatagattaagtttgggctggtaaaattactatctggtcttaccagtgtttaatgtttttaaacatttaaccattgaacaaaagatgggtactatacttcaagggaattatgcctttatctctcctggttttttaattcaaaatagaagcttgactaatgtttatacaaatatgaataaaaattcagatcaattaagtcaaaagattttgttgtgataagaataactttaccagtctatctttaattcatcatacaagacccagtgttctgaagctgtgttaccagatgcattataattaagttaataatggatataatagtgatttatttgaatgcatccacttcaactattctctcaagtcctgtatacctgtaagtaatttatctgttcttagatttgtttggtattcagaatagaattatcactttggatgaaacaagacacagttttataaatgttgtataaagagttctgggaaacaacatggaaaccatttattttactaaatacactggaactggctctttaaaagtatagtatcctgaaattaagagactcaccaaaattttctgggtatatagctgtgagttaggtagaatagttaaggaaataagacacaatctggaaacatttttttttctctttcagttctaccagacttcaatgctttaatatttatctcttgaacactttgcatttttcagttaaagtatgccatctaactacagaaaaattatccttgatatgattcaagaggtgcatgatgccactgaaaataaaatacaagttaattgggtcaaaggaaaccaagctgattatcgtacccactttgtagctacaatcccacgtgataatacataggcctatgaggaaatatgtacgctgctctgctagagttgtttttaccaggaaagtggagctaaatcttaacactggagtcaggttctgaaattaaacaaaaaaaaaaatacatatatgcataattaccattcaaaatctcttaggaatgtgtcttattggaaaatactattgctcaatgaaaacattatactggggactaacatctcatattaattcccacctagacaatttttcctttagcatgggtacagatggctgcttattcagtggagtaccagaattagtcaaaggtttgcttttagaggtcatgagttatgactcatccttaggagaatgaagtgcttccattctgagaggcacatgaaaattcaatctcctgagagaacatcagattcacatcttttgcctcgagctgcctgcaggatatatgcttataaattagaggtggaaaaaggcccataataacatttatattttatctctagctttgtcctatactaaaattttcatatactaaatgcatgtcttgcctagctacagaatcacaaaaatggatttattttcatttgtatcctcatatctaaacataaattggcaaactatatacacttacaaatactttattaatgtaagagtttaatctgatgtttatgatttcgatattttaaaatttaacttgataaagtacaaaattcaattagttacaggattataaaatacataaaccaaatctatagggtctatgatgaatttccttttttttccctgatttcaaatcttcattccctataaatcctaccccacccgcttcttttattcaagaaattttatgctctccattacccatgggttcccttctaaacaatggctcttgtcttccataacttgactctggtttactttcaactttagacaccactacttctatatacgtactggtttggttctcctaatcattgtcacataatcgttttatttcttgcatcttcacaatgtgtttatcccatatctctggtcctaaacggtcttcccaccaataatttccaacttaactcctaccagctctgttataaccaaagcaagccttatgtcctctaattctgccagaatacttccctcttcttagctcatatgatgacaactattaataccttgtcattttattgagaattcatattctaattagagccaggttctttttatatattattttattcaatacttaaagcagagaaatagaaggatgactattcttatgttacaagcaggataacataggctgagaagtaaattacttgaggtaaaaaaacactagggtagaggagctgtaacatgaatcaagaaccctttaaccctcaaattatgctctttccacatataccaagaagcctcacaacatctttgtgtgttccatttagacttattaaatttgctatgttattattcctactgtgttttatgtgagtaatctctaatcaactagattttgattaatcaaaagccatttcctaaatatcctaatgatagtccaaaacacagaaagtgtttaatacaattattgagacattttctaataagaccacattgagtttttatgtctatttttttttctgatgccaccagcaacaaagtacagcaattcatttaaaaacaaaacaaaacaaaacaaaaaaacatagtgtggagaaaaaggaacacctatacaatgtcggtgggagtgtaaattagtttgaccattgtggaagacagtatggagattcctcaaaatcctaaagacagaaataccatacgatccagcaatcccattactgtgtatatacccaaagtaatataaattgttctattataaagacacatgcacacatatgatcattgcagcagtattcacaacagcaaaaacataaaatcaacctaaatgcccatctgtgatagactggataaagaaaatgtgatacatatacaacagagaatactatacagccataaaaagaatgagattatgccgtttgcaggaaaatggatgaactgggggccatcattcttagcaaactaatgcaggaaaagaaaaccaaatactgcatgctctcacttaaaagtgggaggtaaatgatgagaaagcatggacacagaggggaacaacacacactggagcctattggagggtggaaggtaggaggagggaagggatcagaaaaaataactaatggatgctagtcttaatacctgggtgacaaaatagtctgcacaacaagcccctcatgatacaagtttacttatgaaacaaactggcacatgtaccccttagcttacaagcaaaaaagaaacaacataaaataaaaaattctgatggaactgtttctaaactctgctataataaaagctaatttttcacctgtagccctcaagttccttatcagtaaaatgagcttaattgtgaagtcatttctagctttaaaattttgggccaggccgggcacggtggctcatgcctgtaatcccagcactttggaagcctgaggtgggcagatcactaggtcaggagatcaagaccgtcctggataacacgtgaaaccccatctctactaaaaatacaaaaaattagctgggagtggtggtgtgtgcctgtagtcctagctacttgggaggctgaggcaggagaattgcttgaacctggaagagggaggctgcagtgagccgagatcgtgccactgcactccagcctgggcgacagagtgagactccatctcaaaaaaaaaaaaaaaaaaaaaaaaaaaagaaaaaaaaaaaaactgggccaaactcccaggattattaggcagttcaaatgagataaatgtaaacagtcttcaatatgaaatactatgtagatatatagaactgttattaatttgggtttaagattaatacataaaataataaattcatttgcaatatgtcctaataactaggagacttgatcgtttagtggctctaattctcaaaaacgtgttgaagttgaattgtatttttatacagaaatcaggttaaaacccaatattattatacacattgttaccaacttctgattttaaatattagaaaacactatactaaatacttataatagttattttttgcattactttcaatatacagtatatgtggtaattggcttgttgacagcatgttggcttttaacatttccaaatttaagtttttgtacttagtttttggtttctctgttttacttattttgtaataatttccaggggaagaagtctcaagttttctttgagagcttggctttctcctttgatttcttcactttgtatatgagaaaaagaactgcttatggaaatgcagtatttcatattttagtaatcaatcaaaagcaataaatattgcacaatcagcatattagcaatgcacttagatatcttattgatctcaggaacattaacactaccagcgttatgaccacattctgctcttggatacatatgctattctcagtggctcgatttcattaagagctgtgttcatataggcaagggcaaaactacacttaaaaatggactcagtaactgcctgtaaatttattttaagagttttatattttattatatatttgggatatagcatgcataccctgtatttcttggtaaaaacctaactataaaaaaaaaaccaacaaatgaacctttaaaatatgcatttacttctactgctccatttggaacttgtcaaatttggttaatatgaagttaactgttaacataataaagtacactggcctatatggatcctgtggtgaaatttccaatatcatatatgtattaattgtgaagttatttgagtttggtacaagtacacacataagaatccaccggaaatataaatacaagtaaagcataacaattcagtgaattccctttgggatctgtcaatatggggaaaaaagagttattgggttctgttataaaactcgttttgctaaggatagaaaaccaaataccacaatgttctcacttacaagcgggggctaaatgatgagaacacatggacacatagagaacaacacactggggcctactgcagagtggagggtggaaggtgagagaggattaggaaaaatagctaatgggtactaggcttaaaacctgtctctggaaatatctgcacaacaaatctccatgatacacatttatctctgtaacaaacctgcacatatacccctgaacttaaaataaacgtaaaacaaaaaacacttgttttgaaaacacaaatttgtttcagcgtaactattaggaaacaatttgagaatgacacaaattacgcactgcatttgtgcagtgtcatgggtgagaaccgctgggtgaactcagaaattgcattctgctcaatggaacaatggagttggacacaaaacacatgcactcacctcaagtatacaccagctacctcagttcactcccacccacatctggcattcaaacttcacttcttatttcagatagcccacattctatcacttcacaataactaacaaaagcaaaccctctgcatgctcacttccacgagcattgagcctttttcaaggtaaagtgtcttatttattgtattatttatatacatcttaaccatctaacatgtataaaaccatgatcccattttcattagattcttagatatttttatatgacactgacaaaattttttaaaagtgtctttttgcttaactccattttgcatagaccttgtggcttttattctacaattttgcatagtgcaaagaattttaggaacacatatgtcattttatagcagaactcggtagaccataaaactatatataaataattttgagaacttatattgatctgatagagacaatgataattttacaagattattaataatctattatatatatattaggcataattttatgcatggaaaattatgccaactctgatttttaggaaaatatagatataaaacaaggcaaaataatttcatttaatgtagtcaatatttttatcttcatactactaaagcaatagttggaaacatttaatgttttactttcatgaacctattaatgatatggtctatgttattaaacttttgaggtaaatataatttctcttttatatgatcaccagaacccccactctcaatttgctcaggaattattaaatactcttctagatactaccgcacaagtaaaaaattgtacaaataaaattgcacaccctactgagaaaagaactctattttagtaaccttggtaaaaattagagtattttgaaggttattataatgtacacccagagtaatatttaaagctgacaaattaggccagccatggtggctcacgcctgtaatcccagcactttgggaggccaaggccaaggcggacggatcacttgaggtcaggagttcgtgaccagcgtggtcaacatggtgaaactgcgtctctactaaaaatacaaaaattaggtgggtgtggtggtgggcgcctgtaatcctagttactcaggaggctgaggcaggagaatcgcttgaatccagaaggcggaggttgcagtgagccgagatcgtgccactgcactccaacctgggtgacagagcgagactgcatctcaaaaataaataaataagtaaataagtaaataaataaataaataaataaataaataaataaaaacaaagctgacaaattaaagtcatatttatttttatgctaaatctatggatgtttcaacaatacagtattttatagcttggaacaagcttatcacatatacaaaaaaatcacttacattatagaaacatgacttagtttagaaaactagaaaaggtcaaaaatagcagcacatacttataattcatatctttcatttgaaacctatgaagactgaataaagacatatgatatatatatctaaggaaaaagcaaataaaaaaagactgctaatattaaattgtcttgaagttaaaattagccaaatactcaataccatccctgctgaagtcctgtgacattttcagaaatattttaaaaatctgaaatgcaaattaatgagtattgtcttccattgccttagctgtctttttcccattcattaatacttagttttaagaaatcaacatatacttattctactactggtaggtaaaataattcaagtttcattctgttttctaatgctggtttaagataatatttccaatgtttgagtgcaaaattatttactcagaaaattcagtgacaattcaacttcactataatctacttacatttagaaaacaaattttaaaagatgcttatcttttctctttgcctttagcactatgggaaaaaatatttttgaaattatttaaaatgcaattaaaagtgatttttaaatttaatttgattagcaaactaaaaagtcaatcacgttttaattctacggatcaatatcagaaaaccaatcacaaagcaaatagtattagaagttaatttcatataatgtttttacttttattcatctacttagggataaatttacagatgtatttaccttcaaaaaacatttattcgttctgtcagtctgaatttattgaccacaatgtacatgctaaggttaaaaacaattgtacaaaggcttatctgccatcaggatgtatatagtagagtagtttatttttattttttgtgcaaacttagtaggtatatatattttggggttacatgagatattttgatacaggcatgcaatgcatcataattacaccagggtaaatggggtatccatcacctcaagcatttatcctttgtgttacaaacaattaaattatacttttagttatttttaaatgtgcaattaaattatttttgactatagtttttcaaaattaaatatctcttaagatttccaagccttttaactgcatatatttttcagagatcattagcatagaaaatttaaataatcgactcttcctgcactgctttaaatcatgcagtacctccccactacctgtaagaccatgtatgatcccagtattcaattttgtcttatgccacactcaaacactgcacttcagccataactactatttgcaatataccagaattcaccacgtgactcttgactcaagtgctttaatcttgctgtttcctctgttaacattcctccctgaatcctttgcatgtctggttccttataaccttttcccagaatcttccatcgtccatgtttttgtctgtttgttcttgttcattctcattctcatattcattagttcaatctctacctgtctgtctgcctgcctgtctctctcttgctccctcattccctttctgcaggcctctgtttcagcctctgaaaatcatcaaaaacgtgtgtgttgcagtgcacacaaattcacagtctttaaggtttatatcaaaaatcgaaaattctgcatcatacatgataaatattttcaacttgggtagataattcccaaccattttctaaagtggccctgtaaatttatatttctgctaagagctcctgaagcttcacttctcagttatcacttggcattaacaaacattttgaagcaatttttgctaatcttatgagagtgaagtgatattttattgtggctttaatttatattttcctgattattaatgaggctaagcatcttttcaaaagctttgaatttcctcactgaaaagttccgagtcaagtattttactcagtctctatagggcttttgatagaagctcttcacacaatctgatacatgcttctactcagttatatgcattggaaatatcttcttctgcccatttattggcctttctaattttttaatagtgtctgttgataaacagaagttaatgatttaaatgtaaatgctattttaaaaatgttttcccttacgctactgttttaaagtcttgtttagcaaagcacctatcttcaggtcaggaagttaatctcaatactcttctatctatttaatgtttctacctttcagcttttaatccatttggaattctttccttatacggtatgatctgaagattcagatttctttctttccacatggacaggaaatttctcagcaccatttgagagagaacatccattttctactgttcttcagcactatttctgtcataaatcaagtaccatttatgccagaatctgggtctatgctctctattgtgctccatcagtttacttgtctaccgtgcaaataatgcactcaacttgattaccatagctttcttatatgctaggttatattgcagaagaagctcttcgatttttcttcaagaatatctttgttattcagagagaaaaatactacaggttctcactcatgcatggaatctaaatatgtcatactcatagaaacaaacaacagaatggtgcttaccagggcctggggttagggaaataccgggagatgttaggcaaaggtacaaacttttggttacacaagacagttcctggagatctaatttacaactatatgacaataattatattgcatggtacacttgaaatttgccaagagagtagatcttacatgatctaaacataatgagaaaaaatggtaaatatgtgaagtaatggatatattaattagcttgactgtggtcaatattttacagtatacatgtgtatcaaaccatcaagttgtataccttaaatatatataacttttaattgtcaaaaatacctcaataaagttgaaagaagaaaaaagtgaatgtttttgttttcctgggccatttacagttcactataaattttagaattggctagctggattccaaaacaagaaaagcagaacacctgttaaaattcttattttggtttcttttggtcagcttttaaaagaaatcttctttttaatactgaccactgaccatttcaatccatgaacaaagtaagtttgtttatattttagtctctcaagtttttttttttctttttttttttgagacttaatctcgctctgtcacccaggctggagtgcagtggcacgatctctgctcactgcaagttccgcctcctgggttcacgccattctcctgcctcagcctcccgagtagctgggactacaggcgcccgccactgcgcccggctaatttttttttttttttttgtatttttagtagagacggaatttcaccgtggtcttgatctcctgacctcgtgatccgcccgccttggcctcccaaagtgctgggattacaggcgtgagtagtctctcaagttttattatttccactgtgatgattgtgagcatcttttgttggattctctcctaggtacttgataatttttatgctactttatgttgtattgttattgtcatttgtcccaagttatttttgaatttcccttttgatatcttctttgacccagtaattgttcaggaacatgttaatttcaatatatttgtgaatttcccagaattcctgttactgatttctagttttataccattgcagttggaaatgatacttgatatgatttcaacctttttaattttgttatggcttgttttgtagcctaacatatggtctttcctggagaatgttccatgtgcactagaaatataaatgatatctgatttttaagtttactttcttaatatttgtttttaatataaaatacattaaatttacctgagatataattcatataccataaaaatgattcttttaaaatttacaattcagtgatttttagtatacagtaagtccttacaatgtcattaataggctctttgaaaccgcaattttaagtgaaatgatgtataataaaaccaattcggccagttgctgtggctgatgcctgtaataccagcactttgggaggccaaggtgggtggatcacttgaggtcaggagttcgagaccagcctggccaatatggtgaaactctgtctctactaaaaatacaaacattagctgggcatggtggcagacacttataatcccagctagtcaggaggctgaggcaggagaatcactggaacctgagaggtggaggctgcagtaagccgagatcatgccactgcactccagcctaggcagcagagtgagactccttctcaacaaaagaaaaaaaatattgccataggctaattgaaatacataagagtaaatttcccatggcatatttctggtcacaaaaacatcaccaagcttccaaataaagaccacagactcttttaatattaaaaattaaagtcaatatgagctatacatgcatttaagaaagattaataaatacaagtaagaaaattatttaccaaagtttcggtgaataattgagtaacagtggttgtaggttaaattaaggcagtggtgcgttaaatcaaggaataaatgtctgcaaattgaatattgtaaggagcaccttcgaccatcacacagtacaaaaacaaacagtaacaaattgggtgggctgaatgctctcaaatcacattgtttattgttgtatgtttgcatgattatcatctacttcacaaatttttattttataataatttgtattcatttattttccaactgacttatttcagctcagggtggtgggtggctggagcttatcccagcacctcagagtacaaaggcaagaaccaaccatggacaggatgtcattccatcgcagggtacatttacataaactcacactcactcatactgggacaacttagacataccaattaacttaacattcacatcattgtgatgtgggaggacactggagcatctgaagaaaacccatgcaagcgtgaggagaatatgaaaactccacacagacagtggtcccagttaggaatcaatatttttctctcatcaatgttatagtgaaacaacattgaatgaaagaacattattcaaggacctgctgtgttcaaaaatttgtgcaacaatcacagctatctaatttcagaatattttttatcaacgccaatagaaattacatgtccatcaacattcatttctcatgccaacccaaagactctggaaaccattagtctaccttcagtctttgtaaagatttctattctggatgttttataaatcaaattgcataatatgtggtcatttgtgcctggcttctttcacttagcatatgtgtttaaagattcatccacgttgtagcatgtatcactactttactttatatagatgaataatattccattgtacatatgttgcacttttttaatccatttattagttgatgagcatctggatttttccactttttggctattataaacaacattgctatgaatactcacatataaattttttgtgtatgtggacatatatcgtcaattctcttgagtggaactgctgggtcacgtagtaaccctgtgttggagtggaaatgctgggtcacatggtatccctgtgttgaactttttgagttattaaactgttccccacagcagacgcactgtttcaaattttcgccagcaatatatgaggttttaatttcttccacatccatgccaacacttacaaaatgtgtgtcatttttattctagccattctagtaggtgagaagcagtatctcattttggttttgatttgaatttccctaataactaatgatgttaagtgtattttaatgtgcctattgtctatttgtagatcttctttagataaatgactattcaaaattttttctcatttttaattgggttatttgcctctgtattattgagttgtgtcctagtccattttgtactcttataatagaataaccaagactgggtaaattataaataagatatattttttacagttcaggagctggagaagtccaaaatcaaggggctggcatcttaagagttcctcttgctgtgtcatcccatgttagaacacagaaaggcaagagcgtgcaagaatgaaagaaagcgagagagagttgaacttgcttttataacaaacccattctcacaacaataaacccactaccagaatataattaatctattcatgaggacagagccctcataccctaaccacctcttaaagctcccacctcttaacaatgttggattggggattaagtttcaaacacatgaactttgggggacacattcaaaccatagtatttatgcctggcccccaaaatttatgtcctcatatgcaaagtacattcattccattacaaaagcccttgtttttgttgttgattctctaataaaataaattacagaattggttctcatatgctgaactaactttgcattcctgggacaaattccacttcttcgtagtctgtaatgcattttcgtatgttgacagtttcagcttgctattattttgtgcaggatgtctgtaaaattcttccatgtccttcacgtatttattaccagttttcattattctgtcattcagatttaagttattgtctgttgttctttcatttcagcccggaggctgagtatcaaattcctatgatatgtattgtagggctgatgtattagcaaataactctcttggcatctctccatttgggaatgtcttaatttttccgttttttgaaggatactttttctagatataaatttcttggttgacttttggcagggcgcggtggctgatgcctgtaatcctagcactttgggaggccgaggcgggcggatcacgaggtcaggatatcgagaccctcctggccaacacggtgaaaccccgtctctactaaaaatacaaaaagttagctgggcgtggtggcgggcgcctgtagtcccagctactccggaggctgaggcaggagaatggcgtgaacctgggaggcggagcttgcagtgagccgagatctcaccactgcactccagcctgggtgacagagcaagactccatctcaataaatagataaataaataaattttttggttgacttttaaaaaattgttagcactttgagtatatcatcccactgtcttctggcctccatggtttctgatgagagaatagctgttaatcatattgaagaccctttttatataagtagcttgtctcaccaatttcaagtatttcaaaggtttgattatatgtttacgtacagatctctttgaatttaccttacatggagttttctaagattcttagatgtgtagattaaatcaaatttgaaaagtttttttctttttcaacttttaagttccagggtggatgtgcaaggttgttacataggtaaacgtgtgccatggtggtttgctgcatagatcaacccatcacctaggtgctaagcccagcatccattaactattcttcctgatgctctcccccaaccccacactcccatgacatgccccagtgtgtgttgtgttgttccccactcatgtgtccatgtggtttcattattaagctcccacttataggtgagaatatgtggtgtttggctttctgttcctacataagtttgctaaggatcatgacttccagctccatccacatccctgcaaaggacatgatcctgttattttctatggctgtatagtattccacagtgtaatatgcaccacactttctctatccagtttagactttatccagtctgtcattgatgggcatttgggttaattttcagcctttaccccttcaaatatttttctgtccttttctccatcttcttgtcagcatagttgatgttgcctcataggtctctgagtgtcagttcatttttcttcgttctttattcttgctattgctcagactgaataatcttaattgatctacaaattggctgagtttcttttatctactcaattctgctgttgaacactaacagttaatatttttatgtcattcattgtactttttcaatccagaattcctatttggtttgtgtgtgtgtgtacatatacatatatacacatatatgtatatatacatgtacacacattttttatatatatatataactttatctctttactcattttctcctatggtgagacatttttcacttgctttccttatttgaacatggtttcaattaattattcgagcatatgtgaacagccaatgtaaaatcttttattaataagtgcaatatctgggcttcttcgaacataatttctattgacttttcctgagaatgggccatacatttttatttctttgtacatatactatttttttttttgaaaactgggcttttaaaataatacaatgtggcaactctggaaattagattctccttccttttcaaagtttattgttgtactttttgctgttttgtttacttgtttagtgacttttctgaactcattatggaaaagtggtattctctgtcatgtgtggccattgaagtccctcctcagtttacttcttagtggtcagttaatgattggacaaatattttgttaaatatctagagccaaaaaattcagtttttcctgaaggactctgtactcatatgaataccttcattactcattctagcaatgtacaactctgccttaacttcacttcctgcattgtcagagcctcaaggtcagtcagaggttagagattaagggttgttaagcctttcctgtgcattttaaactctggacatgtgcatagccctatgcttgtgtgtggccacttgattcccaagaagatgttggattttttcaaaccaccctatgggcatcttgttcctcgaattttactttcaaggtttttgattagcctattgttttcatcatctcttattctcccaacgagcaactgcaataagcaattgcctctgattgtttttgagaaacaaacctagaaaagctgttcacacttcaggagctgtgaataaagacagatttatgagtgggatctttgttggaaccatgatacagggaaaattataaaaattatctgaaaatagggctttgaaagatcaccctttttcgccccagagtcacttattttaaaagctaccttcaaactgggagtgggaaattgtaacagagcaagttaaaacaccacaacgtttattgctcttaccaatattcagttgctattgaataaacactacctagattgctaaacacttttatttccagagttttgaaaaattatattctgaggatttttgttcatgttctcaatgcttttatggaggagaggatatatgtagttgcttattctgactattttgctcaagttactacctaattttactatattgatgttttcttttatccatgtactttgctaatatttcttaaattgtttttctgaagataattttgttttcataggaatacaataattgaatcttcaaataaagacatgctattctccttgcaattctgtacctgtaattttttgttttgttttgttttttttttgccttactgcaacgtctagaacttaaagaatcattcagagtagaggtaataataatgggcatcttcctcctgttcccagtcactatgaaactttgagtattgtcataacctcagattaaaagatttccctactcatcatagattgctaacattttttgtttgagtcactggtgaattttataaaattattttttctgcatcttatgagatgattttattgtcgtatgtcttaaatgtgttaatatggtgaattaccaagaattaactacatcagtcaaaagccatgaatgcatagttataagaagaccagctatagcaaataaaaaaaagatcaggaagtagtaataaaaatgcttttcttttctaaaaaatgaatatttggacacacacagtttgtacaaactgctgaggagaacactaaagataacactggtccaatttaatgaagttttccactgtcagctctagcaggtgcatggaattgaataatttacaagagatttttggcaagttctacatttgtcatctcccttaaaagatgtggtgactggaaatcatgtcaataacactaaaatattcaaataagcaccaactatatgtataggccagggttgcagaacacatacactgttttaaggttgcctggatttaaaacccagatctgccatttaatagctatgactgtgggcatcacacttattttcctgagcctcagtttcctcttctgctactatattaacattatcttcacagaaatcttgtaaggattacatgtattatatatgtcaagtgcttaatagagactctggtaatagaaaattctacacaagtgttagttatgattacgtattttttgaccactttaacagttccaccttagatgggttctatcattgatactaccttttatttctataactaccataaattttcattcttatttattattgctatttagattgctagtataatactcatcccaataaatcagtactaatattggggaattagattttttaatcactgtccccaacttttactacaaagatctattaaaggtgaattaatgacaactttagtctaccatacagacatagtattggatttataatctcattaaacctttaaagacttgtatttcaatattgcttatatttagaatttcaataaaactataagagagcttcaaggataataatgttctctctcttatgagtttcatacttgtatatgttcttctgttgctgtttagtgtcccttagtttaaacttgaagaacttaaaaaaatggtaaccatgtgaggagatggataccttaatagcttaactagaataatcattttactatgtatgagcatatcaaaataacttgtataccttaaataaatatataattttctttagaaacaagtaaatagtaaaaaataagatttgttttgacattataactgtttcaggatccttagggtgttaacttttccacccagaaacctctgtggccagtgttgcctttgtcagagttttggttgggcccactgggctcattccactcactcagcctggcagactgcacctgtcttgtgctactggcctgtatcccatgcctgccaagggtgagccaggcatgtagtggcaaggggtgtgtgagcgagtgtgtgtggtccagacactgcacacaaccaggcagaccggtggctgtggtggtgtgggcagctccaggcaccggctccatgcaaggctgtggctgtatcagatttactacaagtggcttctactatgggcaccgatatctggatgagggaaatatgctggtacctggaagcttggagacaccaggaatcatagagccccaaagagggtgtcatagccctggttcagggaacccttaggtctgggctccccaaagggccacagctcttctgtccttcttgtcacccacaacgtggtgagcaatgtggtggggggggggcatttcatccctgtttttgttacagctctttagtctcaccatttggtgggtcctgagttcttgtcccacatctaggaagaatgaggtacaccgacaactggagggtaagcaaggcagagaggaggttcattgagtgacagaacagctctctggagatccgaagtgggtagctcctttcagcaggcaggtgatcctgacaagtgtctaggtctcagtgaagaggagatgcatagtaggtagctcctttccacaggcaggtcatcctgacaagtcaagcagatccaaagtgggtagctcctccctgcagctggtaagtcctgacatctgtgtgagtgtggctgagtctggggttttcatggctcagaagggaggatgcaaatgctaactggtccatggactgccatgggtgcgtccaaaaaaagcaccatacattcttactctgggccacagactccacctggaactgacaccctggcctccaggcttcaggctgtccctggcttgaaggtggggcttctggagggaccggtccctttccacccaggaacctgtctgcctcccactgccatcaacatgccatccatggcacccatgctgttcatgctgaggggtgcctgcaggccttcactgagctgccctcagccctccctgctccctgtctccctcccatgcttattggcacccgaggtctggcgggggctgaggcagcagggggccggcatatctgtgctgccctgagcatgcgcacacccatcaggtcatgacagtgcccaggcttggctacaactctgctccacactggagtgggcaccgggagtggggagaggccagggagggggagcaggccctcctgagcctgcaggggcagggggagcttcttgggcccctgagagtacagggctgcccaggtccagagccacagctgggtggctacagctgcacccaggagtgcagggctcccaccctgccaactgggtagggggctgggctcccacctgtttctggcccctgccagctccatggagcatgcagccctggccgtgcctccttggctgtagctggcatcctcacagcagcccctccagacatgctgttgctggcatcttaatgataattttatatttcttattaagtatttccaagttgtgaagtaagctctcatccaaacgctgctataaattcttacaaaggtaagaagtatcccttagtaatcataaaacaaattagttccagtcatataaaaaaggagaaaatagaggtgaatgttccattgcattgatgattcggaaatcatagatgatattctgaatcaagccaagaaatcaaaggacattagaagcaacaataaagaggatgagggattttagaggtgagagaatcacttggaggtgtaggagtcaagagaaaacttcccattcaccttctggaggtttgcaaaaaaaatcaactcacaaaaggcagattaataggagaaagcgcatacaaatttagtttaatgtggaattataggaggatgattacccaataacccaattaggtatagatgattatatagtcgtcttcttaggggaataaacagatgagaacgtgttgattattttagggggtagtaaatgacttttatggaaattcaatgggcttgaataacacacaatggcctggaacaaagtctgtttggcccttagagcagacaatggtttgtgacaaaagtctgcacaggtttgttgacagcctttagtctttcttcctgcaatgcgttcagttaatgaaagctcaggcaatggacaagaggtggttgttttattctttggtagatccagactttaggcaggtaaaacagcttcagaggacaatttcatcctgtactttgggttgtacacaggattgagagcaggaggtggagagggtagggtgtcagaccttgaggcttcttgttcagctcagcatgtcaaagtgtcatatgtggggcattagtttctgagccccaacaggggaaagctcccccgaattttgaatcactacttcattttaactaatggcagcttgtgagataatacaccttcccaggttttattcaaccttcatgatgtaaaacagaactggttaaaatgataaatgacaccatggtaaagcctgaaatgttgttggttaatagacaatattaattaattcattcatttttccatttgtctttcattcagaaaatatagttaagtacctgctatgaagttggtgtgggagatagaagaagaaaaggacaagtgtgatacctttcctcatagagagtggtagacaataaaccagcaagcaagccacaagtagacgaaataattttagtaactttagtgcttttagtaaatgctaataataagagtcatatgataatgaataaaactttgagcaggtatattttaaataagtttgtaatggaagactcactgaggaactgacaggaaaagcatttaaaccgaaacttgaaagataagcaatcagccataggaagggctagtacgtatttctagcacctacatcctacaggcccagagcttgcatcagtagtgaatcatggcatatttttctggaaatcctgaaggaaaactcagtatctttcacaacttcctgctgccaactcaatatcatattcctacaagctaacgagatgaaaattactaccattctgggtccggatctcttataacagtaatctttatttaccacaactcttaattctgccttttattcattttcttgtccaggaaaactccctctccagaaataatttctcccatgatattttatgaacaaagctttgtctttgcatttagggacttctgcggctcatctgtgtagaggtgataagtctatccatccaagagagagcattggggtgctcttaattttcacgtagtattgttaatttctccatcaccctatccagatctattaattaccagtctcctagacttgaaaaacttctcaaataacacaaactttaactggctgttcagcccactttatgagaattatatttttgaagtattgtgcattaatccctctatctcagcaaattttccccaaactttaaaaatcaaactcccatatttatgacaaggaacttgaccttgctggctatactgccctttcatccctgatagtggcccctaggactctctagaggacctttatttgtgtgaatagagttgcaagccacagctccatgtaacaaacatcctttcatcaaaagagaccataaaacaatattatatttcataattggaccattaaaaaaatcttattcatctacagaattggacttaataagtagcattttgttgttatgttcccccattgctttaataaaaatacaagatatgttcttatgaaataacctattacaatttccagagagatatttttgaggatgtatttatctataggttgatgcaaaagtaattgcagtttttgccattaaaagtaatggtaaaaatcgcaataacttttgcaccaccctaatacaacattcctcttacttgatccctcatgtacaaggtttagaggaaaagttttctgtgccttttagtgttagactattctattctcttcagtaatccggatttatcacactgactacatctccctctactttgcttgtcacgaactcgaaaaaaatttctcagtcacacacttatgtaggcctgcatgtatgaattatacctcatcttttccctttgacctgtttgataatttatgtcatttactttattaaaattgtttgttgtatatctactatgtaccagagaatgtgatatttacaaatgaaaaccataatatgcaggacatgtcagggacaacataggcaactggaagagggcgactggccaaagaaaaggcaacagttctgaagtgctatggttggatcacctgaatctcacaattatttgacttaatcctccctggtccagccttctcctcactttgccattgccacctctatgagttacttgaatgttttttcctccttagtaaaagaaagatttaactctaaattctgatgtataaaatatctgtgattataatgctaaatatttgatttagcaactaaatgggtttaccatcttagcagctttattaaaaaacaaattatttcataaaatgtactcctcctgattaatctctccatgagacacatctcacaataacaacatgtactaaattaataactttaaaacatggaatagtcacagctaatatccactgaatttggttaaaggtttgcctcacatcagaggaagtgacagatttttttctttcccaggaattgtattagtgagtagtttttccctgtggggatcttgctacagataggcttattttttaggaatttattgaagtttcatcttcatgtcattaatatctctgcttcccatgttgcccatttccaaaaaatctttacattgcatttggagtgacataatatttttttcttagataagggattggggactagaagatgcgtgtcatgaaaacagaatttgagtagcctactgtaaaaaaaatctaggtggttgaatataataaacttgatgcatacatatattttacatagtcaaagctatatactgttgtctcaaaacaaaatatcctattccttagttattttttaaattcccctttaaatacgacttgatatagtaaaaagagtaaaaatgttggcgtttctctcctggttctgacataactctttcaaatacatcatagaagaccattgactccctgcgtatctgtatccatcacagtgcagacaatatatagatggcacacaatgggataattgaaatgaggtagacagggttaaattaaccaataaagactgtgaagcatgcagagattaataatactagaaagctcttatcctcctaggcctgaagggaaaatggaaaggagataactacgggggcctagtgagagctgagctttggaagacagggtgtacaaaggtggctgtggccatagttagaaaatgcaggccaggcaccgtggctcatgcctgcaatgctagcactttgggaggctaagatgaaaggatcccttaagctcaggatatcaagaccagcctagacaacacagtgggacactgtccccattaaaaataaaaataaaaaagtagtagggattgatggtgcaggcatgtagtcccagctactcaggaggctgaggcaagaggattgcttgagctcaggaggtcaaggatgcaatgagctatgatcatgccactgcactccagcctgggcaacagagataaaccttgtcttaaacaaacaaacaaaagaaaaccacatttaccctgactgtcagcaggataataaataccactttccccttcaatgctcacctctcttgccagtgatttctattgggttaacaaaaccagaagccagagtacagagataattgcttacagagtccatagagatcagtcttctaggtattaagcaaggtggagaaaggtagagtataaaactagatgggtgagaggaaaatgtcttgcacagtaatcaattctattatctgcgcaacagtagaaacaataatttcctgacttgcttggcttacagggaagatttaagactaaaatgatgtttcagataataattcataacctctaaaacatgtcacaatgaagtgtcaaaatatctggctgtttagcaatttagagaaaatatgcaaaacaaaattagttttcttattttaagtctatttttttctaatgaaaagcttaagaaactgagagattttgaaaatcatggtactgaaaacattccctgttgtgagacattcaaattgtttttaattctcatttgtgtaaatgaaacaaagatgaatatctgggtttctaacacttgtttctctgatacaaattcttgggctcttgacactccattgtcaaattgttttcacaaaacctgcacctattcacactctttattttataatggtaaactggtatctgattgctttattagcaattaattttcttactgattacacacacatatataacatgcctttgcatttaatagtttctcaaaattgtgtcactctttatcaacttttaaaccatttacctggaatattttatctgctacaatattcattatatattttcctcagttttaagtgtaaaattataattttctctttaatccatctgaaatttattttggtgtaaagaaaaggtctaacaggtctaatattttactgagtagcttaacaaatttcacagcattactgaatattgttttattttctgactaatcagagttctttatcatatcattgaaagatttatgttatctttaaattacaaatagagaaagaacagttttcatttatcttgaaatcaattacagtgcattgtgatttttcttgattggttctatatttcctgagccactgaatattccaggaagttcttgaggccatcacaaacgacttgattaatgttttgagtttttcccattaaaatttggacattgcttcagtgttttctagtgttaatgttatgtcaacgtctgagagctacttgatttttgtccttaagtacacaagttttgttggcttgtttgttctattcagatttctacagaattaattttttaagtaccaggataattcttaaaaaatacatttgaaacattttctgtagctcaatctaatgttcctctcttcagttgtggctttgtctttggcaagcacaattgtatataaaatattttccctctttttttccaaattacatttaggtttatatactgatttttgtctttgtttcaaacagattcatttcttaattccatcccctacagagcccatgtttctggtgttatttttgttatcagcacacctggtgaaacttttagtttccatattaggtcgttagattccttgcaatctatgcttaattttatttaagtttattttactctccattttcattttgcatgattgtatttaaagtccatcatctgtaaattacattttgaaaagtattcagagtagcaaggtttacatgtcatttgagaatatatggaagttatatcttttttcttcagctgtgacatttttgaagtaaatatttaagacatgctagttttctaaactgttgagactttttcacaaacaccagactcttttctctattcatacttccttataaaacaatatatctagacacattgtttgtcgatctttagattgtttctggtgccactcactgcccaaaaggattttgatataaccctatcttaatttaaagctgaaatgtaggttgatgtgtgcatcttctggagcaatttagggtgcaatcagagatttatcatctgactttgtgagcttcatgtgggcctgtcctgacagttccctaaaagacaaagatccgtggtttttgcgttgcattgcagatctttaggagttcttggaggtgctctggtgccttccaaggaacaagcaggagccttaattagtgctgttctggcaaccaggcttacatttcaaccacatgtgttctaatttataagtttaagtatttgctttgtatatagaattagatgcgaatgcaaacaatgtctcatagagcagtgctgcttaacatctgtatcagtcacctggtcagctttttaaaatgtactttctcatcctgtgtctctggcctaaggccagaattttgtagttctaatgagctaccaggtaatgctgatggtacagctctgtggaatacacttgaagtagctaagtagtctgggagcctttgagtaatctcagctatgctatagccagttgttatgtataaaattgctattgtttaaatgtgcccttctgaaattcaggtttcaccaattccatagtattaagaggtggggcctttaagaggtgattaggccatgatagctcctccctcttgaatgagaattaggctcctatttatgaagctttcaacagtaccttactttttttgcctgttgccatcagagaacaaagtgtctcttcctctggagaatgcagcaacaaggtgccattttaaaaaagacagagcagccctcaccagacaacagaaacatgatcttgaacttcccagcctccagaactgtggcaaataaatgtcccttctttataaattaccaactctcagatattatgttataggagcccaaaaagtctaatacaagaacatgatgcacactaggaggcacttttcccagagatctctatgtctccgttcacagtgctttttgtgaggaactatattgtttttataatgcatggtgttgccaaacctgctcttaaaatcctataatgttccttactagtatctgtcattttcttgctttttaatattttcttgtggtgatttgtcatagttgtagctgtctgtgatctcttaaccaaacctactgagtttgaagaacttcatacatgaattctcccccttcaaaattgaagaaagttactttgcatccttttttaaagtcaagtcagggatgtacatgtgttagacaaccccagtcagatgcaatctagcaagattcttcttctaaagggagtgaggaaaaaaagagaagtaaaataaagatagtgagaagagggagcagatgccactctctggtgaggatggtgcttatagaaaaggacatgggagatgtccaagagggacatgccatctacacattagcaagtatttaaaaacaaactaggttctactttggaggtggaaaattctctaataaaacagaaagaagcataatttggatattggtccacaatgcataccttccaaaccggaccctctattttgcttctcccacttttaaaaattcctcttagtatttacctgagaaaatacagaatattttaaattaattcccttacaatgaacattagctagcatagtttctgttgtgggcaattaaccatcctgactaatacagtactccctaaaacaaatatttaatttaaacacaaattgttccctgtattaaacaatgataagatagaaaaaataaatttttccttatgaggcatactaatatcatgagagagggaaggacactatgaacagatgaagaagtttttctcaatgtttaattttccaaagtctgtaaaagataattaagaataaacatacaaagcagcagaaatcactaatggaaagaggaaaggaaaataattagatatatttccacataaaaaatcatatgaggtgagtttcatttatctgccacactataatgcacattttgtgttgttaaggtcactaagtccaggaagcataataactttctttttttccaatagtattgatgaagtcttcacttgcagttctgatctgcttctcttaaactggcaaaaaaaaaaaatgctgtaaatatgtctatgctacccaaagcaatttacagatttaatgtaatccctaccaaaataccaaggacattcttcacagaaatagaaaaaaaactatcctaaaatttacatggtaccacaaaagatccagaatagccaaagtcatcctgagcaaaatgaacaaaactgaaggaatcacattacctgatttcaaattatactacagtgctatagtaatcaaaacagaaagttactgtcataaaaacagacacacagatgaccagaaaacaataagagaactgataaataaatccatgtatctacagtgaactcacttttgacaaaagtgccagaaatatacattagaaaaagaacagtctctcaactgttgctggaaaactggaaatcattatgcagaataatgaaactagcccctatctcttaccatatactaaaatcaaattaaaatggattaaaaatttaaatctaagatctcaaactatgaaactactacaagaaaacatcggggaaactccacaggatgttgacatgggcaaacattttttgagtaacgccacacacgcacaggcaaccaaagcaaaaatggacaaattggatcacatcaagttaaaaagcttctgcacagcaaaggaaacaatcaacgaagtgatgaggcagtccacagaattggagaaaatcttagcaaactactaatctgacaagggattaataaccagaatatataagaagctccaacaactctataagaaacaatctaataatctaatttaagaatgggcaaaatatttaaatagacatttctcaaaagaagacatatggatggcaaacaggcatatgcaaaggtactcaacatcattaatcatcagaaaaatgcaaatcaaaactccaatgagatatcacctcaccccagttaagatggctgatatccaaaagagaggcaatagcaaatgctggcaaggtgatggagaaaagggaaccctcctacgctcttggtgaaaatgctgattagtaaaatcactatggggaacagttagaaggttcttcaaaaaactaaaaatagagctaccatatgatccctgaatcccactgctgggcatatatcccaaaaaagaaaatccatgtatggaagagatatctgcactcccatgtttgttgcagcactgttcacaatagccaagattggatttaacacaagtgcccataaatagataaataaagtgtggtacttatgtacaatgaaatactatttagccatgaaaaagaatgggatactgtcatttgcaacaacatggatagaactagaggacattttgtgaaatgaaataagccaggcacagaaaaacaaacattgcatgttctcatttgtgggatctaaaaatcaaaacaattgaactcatagacatagagagaagaaggatggttatcagaggcttgggacagtagtggggatggttaatgggtacaaaaattatttaggaagaatgattaagaccgagtatttagtattttatagcacaacggggtaactatagtcaataatttcattgtacatttaaaaataactaaaataatataattgaattgttttgtaactaaagggataaatgcttgaggagactgatgccccattctccttgatgtgattgttacacattgcatgccgtgtctttatcaaaatatctcatgtactccataaacatatacacattctacgtgcccataaaaactaaaatttaaaagaaattagggagggcatttttcatgtcttcatattttcttgaaattttattatcattagccagaaatcaaaagaatgaagaaaatggtggaaatatttctaaaataataagcaataaatgaaatgtaaagaaaggataaaagatacttattatagtcataatttactcatcttaggtacaatttgttttccttaaatcatgtatgagaaattagggtgaaaggaaattataaacacatatatattcttccttttcaaggtagtaattggttattaaaatcttctctaaatccctgaactctattaagcatctaagaaagatattatttagagcaaaaattctactaaggatgtcacctttgtgagaattatttctaatctaaagctgacacataactggacatttctcaaactagaagaaattacaggaaaatatccatctatgcatatctgttacagttttttcaagttaactaagattttaaaatttaacaaaatttcactttccatactgtattattttttatatcttctgaagtacacaatctacaatctgttccattattctagaagtgtcttagcactttttgataaataagaaagatgcaaaatatataatttcataatctacacttacatatcacattttatatttttatatctgactactccttttaagaagtacttcattgataatattccataatggcactgtatgaaatacattgcaacaccagttcctctatgaattctgttcattgatgacttcacttaagaaaggtttgtgcttagtggacagtattacataaataatccctcttaacatctctctttgcagaagacccacatgaaattccatcttcagtttaaagactaagttctgtgttcagaaacattcttacccaatttaagaaactatattcaaggggaaaattatggggtgtttttctcaactgaggtcaaagcttagtctttggctatctagaaataggatagaaacatcaaccaccagaaagaaagaaaatgttcacagggagaactcagagtgaaatatgatttcatcttacggacatttgaatgggtgcttttgtcttcacgcctttaactaaaagcactcacacttaaaagaatgagagcacacttcttacttcttggatattttatttctactaggatgctgagtagcaagtggaggttcaataaatgctcacaaaacgggcagaaaaagctttatggcttcatgaaactgtaatatagaggcttcttggtcactgaaaggcaaataaatatagatctaaaaagtacatatatgcttccccaagaagaaatctgtcaattcttatagaatgagacaccgactataataagtactctcttactttttactaatgttacttaagtggtagaaacaaactatgaaatggcacatctaaaagatatttttttcctaagaatcttttatttattaaagaagttctactagtagtttaataggcttattttaattcattaaaagtataatgtaagtaaaatacagagcaaaaaaatcaaggttttgaatttttaaaggattaatctaataatggataaaattttctaatgtctatacttttaacttcaaattgtaaaactataaattaactaaatgttatttctcccttaagtctttgtttccaattaggtaagatttttctattttttctgtctcattttacattgtaacttaaatgacatatcatattctctcttgtaatattgtcacttttgtattaatgttattctgctactaaatgatcagttccatgaaggcatgctatagatctcattatttgtcacaagtttttattacctgtttgcgatagattccatctatatccatgattcttcacccctccctgtatctacacccattgctatgtaactttgcatttccttccagtcataggtaaggtaacaggcctgccaattgacattgagctcaactgtaagacttgctttaaccaatggggaactatcagacatggtgcaagtggaggtttaaaacagacttgcacatgggctttgctctcttttgtacctctaccattaacataaaaacattctcaggtttgtttgctgaaggatgaggggtgtgtggaacacagctgggtaacccaaatcatcaaggtcaacctagttaaagtggtcatcagctgaccctaagacatgtgaggaagttcagccaatccctacctagagaactaaatactgaagaaaaataagaactctatgtttggagttactgagttttgggatggtttttataaagtcacaggtaatagatctacactagaatagtatatctattggtataatatattgtaaacaatatgtgctccaaaaatgtggaattaaaaatactttattttgaaaatttatcttcacagacaacaaagaaggtataactaaaacagagccaccagactgaatgaaaaatttgcatttgaatatgttttctttaatcagtttccggtactatataatatagtatagctcaagcacattcaactacagggatatccaaatgacccaataagatcagagtactccaacactttggatatgctgacagatttgtgtgtgagtatataacccactaagggccatataaaatttttatttaaatttcctttccatttttgaggttttaagaaaagggagaagtataacatatagattcttatagtaatttttctctcttcaagggagattcaccaataaatcagagatacaaagtatgctctcagaaagctgtttagtcatttaacaatattagcataaatttgactatagtacaagagagaatatgatgtgtcatagtgttacaaggcacaatgggaagaagtaggagaaaattacaatgtacaaagatagtcagtgggagtagaaataagagacacacagagaaaaagacttattattttatttgaagcactgtatgaagccttgcctgaattctgttttaagtttttaggctaatacctcctttatatttttttttatgagctagctagtaagtgataagtattactgaacaaacaaatggatgattttcattaaaatcaacataggtcatagtctctattctttataccatagccagttgacagtatattatatgccagactatagtgcaaagtgctagtctccagccaaagtttcaaattcaatctctcttttccacaagaagaggtaaacagggaacaagtaaattttaatttaaaaaaaaaaagttgggaaacgtaaaaagtaaaaagcccatagttcagtcccagggtaataaaccatacagactgatgcagggaccagcaaagcatgtgggaaataatacaacacggtgactttacaatctcgttatacatgaaaacgttataaatcccataagataactaagaaagaatgcaaggttacatattttaaaggctctatttttgtacaagagaatatgataattgtaggctcttagtttaatgggagataaaaataaataaaatataacttgatgtgtgctacatattgaaacataaatataatattagatctcagcactcagatcttgatttctaataccatgctcctataaaatacactgaggactctgggagacattgctcattctagtaggtctggagtggggaatatgagtctggagatatatggtaagttagtgccccacacatacacacatggatatgggtatgtcaaaaggacacaggagccaatgggcaaaagtcttgaataatttgtgaagcaaaataaaaaatatattagattataaacataaagaaaatattcataagtcatgatataaattattgaatacataatgggagagtagacaatagctcatgcagaataattccaaataatttatgcagatattttatgttaaaaaaggtagagcatagctcttcattccttaagagtgggctgttcattgtgacttccttccaaggagggcaatatggaaaggatataaaaaatataactttacagtggaaaaacctgacaagcactttccaccaggtgactaagggcaacgtcaacagtgataagtcatgcttgatagcatgtacccttcatatgatgtcataaaaatgacactttacctgtgatatcacccataaaaaccctaattatgaaaaaaaagtaagaccaatttcaattgagaaacatccacgaaatacataaccagtatttctcaaaactctcaagagaataaaaaataagagaggtctaaaattgtcacagccaagagaaatctaaagagatatggacaactaaatgtaatatggtatcctgtatgggatcctggaatggaaaaagatagtagggaaaaagctgagaaaacatggagtatgaatgttagttgatcattatgtattaatattggctcactatttgttacaaatgtaccatactggtatgttaataggggaaatttggtatgaggtttatgggaactccttgtactacaacttttctgtaaatctaaaattgttctctcctctctctatatataatgtatatacatgtatacatatacatatatgcatatatatgtatatagctttctctctctcatacacacacatatatatacgtatatacatatatacgtatatatatgtgtgtgtgtgtgtatatatatatatatatatcaatgataccaagaaaccctagaagaatgtgtggtgtgtaaccatctacctatctacctgaggaggggtcaggacaataaaaatctctgagaggtggcaacatttgggtttggcttcaaaagagaaattggaacttgttagacaaataaggggattgaaggcagaagaaagaacaagaattgatgtttggaggcaagtgaagtcgtgacgtgttcaaacaaagaggacaaattcacggccaccagatagagttgggagaattttgtggctagaatacaaaggctttgcataccatgataaagagtttggattttgttttggagacaacagaccccacagagatgcttaagcaggagtggagtctgtatttggctttaaggacagtaaccataatcacaatggaggagatgatatgaggatactggaagctggaatccaattagacatttctactgtctcctgagtagatatttgaggggatggatatattatttatcttgatttaatattctatactatattcataaatcataacatcacattgtaccccacaaacatatgtaactacaatttttcaatttacaagtaaaaaatacagaggatgtcaactacagcagtagcaataggctagatttgggagtgatttcatcaatatcatcagtatttggtagcaacctgattgtaaaaggtgactgaaaagtaacccaaaaaagattctacattccccagtttagatcagcaggtagataatattgttctttagggtaaaaaggagggccaagatagtttgaagttataagaaaaggaatagaagagagatgacaaaatctcagtatgatagtgaaaaagcttagttcacatgcatttcgatttttatcacccatgtttgtattccttcctattggatgacattcatttcttttttagtatagatatgcctgtaactaacgaagtagaacagtatcttggttaactattagactgcattggcttacttattatcatgtcattactagctgtgtaacctagggtttgttactttatgtctcagtgtctcacttttctcatcattaaatagataaactttcatgggctgctgagatgactgactgaattacttcgggtaaatcatatataacattgccaggaacatactagttgctcaatggacattattcattactacttcatgtcatatttttggcagagaggaggatcaaagcagtgagtgacattaaaaaacattttttacaatgcttcataatataaaatgtactgctagatacatggaactgttaacttttttcccagtagccatatttgaaatgcatgataggttgtagtatctccaatttataggcaaggaaactgaagctcaaagcacttaacatactattccgccatgtaaaagatagtaaattactaggcctggtggagaccttatgccttgtctttttttttttaaatatttttaagttttgtgggtacatagtaggagtatatatttatggggtacatgagatattttgatgcaggcatgcaatgtataataattacgttatggtagatggcatatccaccccctcaagctttccagcattttttccatgtcagaattttgcctgttttcagtgattgaaatatattagagtgcatcattgatacatgtgtaagcagatataggtacggattttagctttgtcccttatctgaatgagtctggaggagttacttctctaaacttgggttaatcagaattatgggataatatttgcttttttttttttttttttgagacaagagtcttgctttgtcgcccaggctggagtgcagtggcgtgatctcagctcactgcaagctccacctcccgggttcatgccattctcctacctcagcctcctgagtagctaggactacaggcacttgccagcacttccagataattttttttttttttgtatttttttagtagagatggggtttcaccatgttaaccaggatggtctcgatctcctgacctcgtgatccacccgccttagcctcccaaagtcctgggattactggcgtgagccactgtgcccggccaatgccttttaaggcatttagccactaattaagacaatgcatataaagcacttgacaagtggttggcatatgggaaggattatttataatctagtccttattattcttatgcgagtcttctaacataaaccttagtctctatggaagcacattaataggttttctgcgaaaggaaagtagcttagtcctgaaaataaagtattgttagttcactatctgatgcatacaatatctttcacagcattaatgttgtgcttttaagtgtccagccaggtattcagatttagctatgataaatcataattgttatcatcccttttattgctattattatatagcacaaaaattatggatagcttttactcaggaaaatcaccatgaacattgtgatcacaagctgtaaagtacaaggcttccaattttatacttcaagaaaacagcaggaaagccacttcggttcattagctttcagtttgtatcactaggcactttgccatattctcaccctaaattatcttacactgatgagatgccagcttagagctggcattttatgtattatagttatacttatttcagaataatacagactacttttattccaaaagatctaagacttatagaagtagggttaattttatgatttcaacaaccatcaataagtacacaagttaaaaagcttaaagcaaaatagattagcacacagtatattttttctgttgatttattaaagatatgtggtgatcattttttacatgccatgtattatgctactaattatctcaaagatgtctaagatgtgtactgaaagggttcatcatctaggtatgaaaacataaataaaagtatagagcgagtatgacaaggagaggaattagaaaaatcaacttggtttatataggaaaagggtttttatatgcctcgatattggatttgaatgcattagaggagttttgtttattttttgtttggttttattttgctttaaaagcaggatgagtcttacatgactttaatgactataacaaatgacacaattaactgttctccttgtaaatagaatgcgtagtgatttttgtgatagtgcatgatgataatgacagctattgatgtttgagtcctcagtatgtgccaggcactgttcttagtgaatcattgtatcattggacttcctcaacaaccctgtgagatttgtacccttaatatactcattttacaggtgggtaaacaaatgatttgatgattgaatacattgcttaaaatctcacaactaggaagtagggaagtcaggatttaaattcatgaagtaaaattccttcactggggttaatattctggtggatagagaatcccttcctaaatgagtaaacacaaatgtaggaaattaaacaaaccccaaatgctatgctttctgaacttagagttgattacacaggagatccagatggccctggatctccttatttgttcctggatagggagaaggaatatgatttatcccatttcttctctttttatctccataagtctagtaacagacacaagagtaacacttaggttgtactaggctcatctaatacctctttatctggaccagcatttaccctaggtctttcataaattactactttcatagtctatttattggtatatgtaaaaataaagttctgttgtaaacaagctttggaagtagtgggaaataaccagtttaacatgcctcctccaagcaatatttctcagaacctttcctacacattgtgaattaccaatagaagcgatatactatgcagtattttctaaatttacttaaccaaagtaaatgtcattttttaatgggcatttcatgtgcctactgttctgagacacattttggggaagactcttctagaaagttcaatataatttcaaaacataataatcacagaaagaattcatattgctctctcactcgctctctttctcaggtaaatctctttctcaggtaaatcaggtgtctttctataggccttgttgcttagctacaaagtaaccaggaaagcttaatgaaacatctgaaaatcaaattatcaaagtacattattccattatattatagagagagtcatttggcttttttcatattaggaagagtcatattcaaaacctacaaggtaatacaagccatctgataacttaattaaataagcattagagcacattttgggagcactctattgtaaataacagaattgacaaccatgttataggatctacatgaactattcctgtaaaagtgtctccctagaggatttcaagtagatacttattcaaataccaaatagcacacattttctgaaagaggaataatactatcagaagcttctatcttgcatgtaaggtatgaattatttgtttccattaacttttctttttaaacttgtcagcaatgtttccttcttgaaaaatctcatagtttctacagagatcattcagattatctttttgctagtttaaaaatttccccacatccagtattgacataatctcttacctcagtaactgacacaaactaggtacctaatatttattaaaatactgtattgatttgtacttttcccagaggaaggagaaccttcattcgctactactaatctaatagatttttcttttctgtttacattaccctttactaaattcccatacctcttaatgcctgtcaaagtgattcttcctcctttaccttcagtagtattgctaataatagctttcagcttctacctgtagtcaccatcatgaccaaatttgtttgaataccagtaccagcagccttctttaaaatggccaagaattgcaaccacccaagtatacatcaacgagtgaatggataagcaaaccgaggtatatccatatgaggagatactatttggcaatacaagatgaagtaatgatacatgctacaacataaatgaagcttgaaaatatcatgctaaatggcacatgccagtcacaaaaagccacttgtttcataattcaatttatatggcaggttcaaaaatgtcatacctataaagatacacttagattagtagcctagagctagagatggaaatagggattaatggcaaatgggcacgaggaatcttcatgtggggatggaagtattctaaaaactttattgtggtgatggttgtataatatggcaaatgtacaaaaatcattgaattgtacacataaaatgaattttatgacatgtaaattatatcccaaaattgtttaaaaaaaaaactactgagtaccactgtacttaaaatgaattctgtccattaccatcagcttatgagttaacatacattgttttatgtaaaagttatctttctatagagacagtcatactgtaccagaaatgcttttgatatattcttcttctagtaactatttgaaatttgtggtaactattttagaagctctcatttagtgactgtgctccaaccatcaggagacgcacattgtattttcagtgtagttggttgtattaccctggaccattcccttcccttatttatctaaaaaataatgatgctcttctttataaagtatttaaatattcatattcaaatggaatatcttccaaatatggcataccttcaagtaagctatttaaataatatactgaaatgtgattattgctctaaaaaagggtgttttttttttttccaaagtttggagagtagaagaatggttaccagaggctaggaagttacattcgattttgatcaaatgcattgaaaatggaaagctatattgccactataccaaatttcaccctcttgtaaaataaaaatagaccaacatgtattaaaaactggaaatcagatactattttataataatacattcatccacaattactcagtgggtacttagaatgcaaaattttatgagtaattaaccagctgaaaattaaatatatttcaatatatatgaaaataaaaaatacaggtgatctatgtttgcaaaaaatatatatgtagtaaaagctattttacctgaaagctattttttgtaattcagataattagaggacgacacaaaatgcttttaagttaatatagtttgcatataggtattttgtagaaccagaaggtaaaataaatagatttttcgccattcctatggtttttcttatcaggaagagttgaatgaagtttgattgatatgttatttttctaagaatgtttttctcattttaaaattgcttttcaacctaattttctgaattttttcttagctaaagtgactaaaacttgcaaaagtctgaaagtttctctgatagtctctaaacacttttacacaaaataggaaatttgaaagtcaaagtcttagagaataaacatccacagactcttatctttaaaatggtaattccatacaactagaaaattaacaaagtctcttctttcaaggcaatcactaatctttcctatagtaaaatattaggctgaatcctagtttatcactgaacttatgttccttcttctttgctaataaatccttgaattaataaataaaatgaaacagtaaaatggattaatggaatttcagtaaggattaaataacataacataccaaatattttgtacattgtctgatatatagtattcaataaatgaataataaacttaataattatttgcccagtaaataccaatgaattctaatctagaataattataaaggtacaagctattctggatttctcatgtatttctaccacaatttggacactaaggaagggcattgacttttgtgcatatttctaaacattattctcaaactttgtccaaaccatttactgaaaaaataccgctaagtgattatcataaaggaataactaaagctaaacattttctttaacaacgaagaagtgtcttaaaaacagcctttaaaactcatggttttattattccactttctccctcttccttactccaaatcctagtccaacaaattaagctccaatcacttttagtttattattattattttttttgaaggagtctttctctgtcccccaggctggagtgcaatggcgtgatctcggctcactgcaacctctgcctcctgggttcaagtgattctcctgtctcatcctcccgagtagctggaattacaggagtgcaccaccacgcttggctaattttttttttttttgtatttttagtagagatggggtttcatcattttggccaggctggtctcgaactcctgacctcaggtgattcgcccacctcggcctcccaaagttctgggattacaggcctgagccaccacgcccagcctccagtcacttttagatatagtaagtgacattaaatggtaatttttttcctacaacttagttccccgcacttgtctcatgatttaaaaatcaaaaatcacatgctgtgtaaagagtactattagaaatattcagcaatctttaaaagctgcaatttcatagttattctttatttctctataactttgacaccgcctaagacatttcaaaagaattccaaaccactacaagcaaccaaacaccatgaggaagcactgtgtatgccttctctatctactaattttactgaatgattaaaggtttatggaaatgaggaaaccccatcttcttccgagaggtatttttgaaagtgttatgagaagggcttcaaaatggctgagtagaggcactgaatattcacttcgccacaaataataagcaaaatagtgagtacataaccatacctcatatagaacaccgaagaaagaatgctggaatttctcagggcaatgatagaaaacacctgaggcaaaggaggacctggaggtgagacagccaaactggtgcgaatcagctggaagccctgaaatgctccccagtgcaagaaaagggtgagagacctccatggttcacattctcaccaaggactcctgcaatcctagtcatggaagagtccctcaaccctcacaggccctgagactggtataggacaatgcctggagtctgcatgacagcattacctctaagagggaactcacattgggtcccatggatccgcggagacccaagtagctacagaatggcaccattttgagtgcccagcctccatcagactgcatcccaccctagggctcaacagccccagcatttccacatccctggaaccccattcacatccctctacttccaactggacggctagagctgcacaaggctagttggacccagcacagcaacagaaaccccagcattctagcacacatggacagtacagcaaactagggaggtgtcccaggataaagttagtcaaagcacattttcccacagcctagaacgcacctgcctggggctgatacgactgacagcaacctcacttccactagctgcagggccacagtgctctcattgctgcagctggaggacaaagtacatgttcccctgaatctgagagctgcctgctgaggtggctgccttctgtgccccgaggagcagggccacagcatacttgcaggcactctgaaaatagaatctctcttcacccactgacgttgctgctgccacccaagcacaccacaagcagcctggggattgccacgccctgcccatcatagcctgacctgatgcacatcactggggtggtcgaaaacaagcccatctagtctgctacagctcaccctcctgcccagtgctagataatgctgctagggggatgggggtttccccaccctgtaagccaccccaggtgcaaacacaaaccacctgagaacctaataatagtccaagaatgcctgcctccaccagcacccaagggtgctgtccagaggccctgccctatttaccacagtttatgcctgtgtacaacatcaggggggcctgaggataggccatccccaaatgggactgcttccctcaatgcctgaggcacagcaactgaggacatgggaaccaccccactctgtcacactggctctgcatgcacactaccaggggtctaacaacatgcccaggaaatctgctgctgggcccaagcatgttgaccagaggactggggattgccttgcccagtgcaccacaattggcatctctgtacttcttccagggccagcaggtaaggcctgcccagcctgccaccacaactgctggcacgcacctgaatgttccaagtgggggtctcagaaatgacacaacccatcacacccatcactaacataagcacatgccacctgggaaaccaagaattgccccaccaccattattgcaaccgtccatgccacacatgctgctcaggagcccgaggacacattcacccacatagcctatggctgccactatgggggcccaaggaatgccccgcctgacaaccctgtccccaacaaagcctcaccatagccttcaataacaaccacacactaagccattaggaaattatggacaacactgacattgttcatagccaaagaaatcacatgaagactacattactgcatgcacccacgatcaaagccaaagtgccctacctacccaaccgacaacatagatatatcttcagtaaaaactcttcccctatgaagtcaaccccccaaaattggaagaagtgactatagtaccagatgtgcagatatcagtgtaagaatgcaagaaacatgaaaaatgatggaaagtaacacctccaataaacacaataattctctagcaacagattccaatgaaaaaggaatcaatgaaattcctgaaaatcaaaatgatattaaagatgtttagtgagttactaaaaaaactaaaaatagagctattatgtgatccagaaatcccactgctggatatataccctaaaatgatgaaaatcagtgtatcaaagagatgtctgcacttctacgtttcttgcagcactagtcacaatagccaagatttggaagtaacctaagtgtccatcaacagatgaatggattaaaaaaagtggcaattatacacaacggagtactattaatccatgaagaagaatgagatcctgtaatttgcaacgacatgaatggaactacagggcattatgttcagtgaaataagcaaggcacaggaagacaaatatcacgtgttctcactgatttatggggcctaaaaatccaaacaattgaactcatggacatagacagtagaagaattgttaccaaagtatgggaagggtagtgggggtgagtggtgggggtgaggtggggatggttaaagggtacaaaaatttatttaggaagaataaataagacctagtgtttgatagcacaacaaggcagctatagtcaatagtttagttttacatttaaaaataaatagaagtataattggattgtttgtaacacaaagaataaatgcttgagggtatggataccccatttttcatgatgtgattattatacattgcatgcctgtattaaaacatctcatgtacctcataaatatatacactatgtaccagcaaaaattaaaaataaatgaaaaaaggacattcagtgagatacaaaataatgtatataaacaatagaaaaatcagaaaaataattcaggatgtgaatgagaaattcaccaaggagactgatatcataaaaagaaacagaaatacagtaatggaattcagtgaatgaaataaaaaatataatctagaactttaacaactgtctatatcaagcagaaaaaggaatttcagaacctgaagacatgtctttcaaaataacccagtcagccagaaaaagtaacagaataaaaaagaatgaagagagtctacatgatatgtagaataccatacagtgaccaaaaatcaaattttgtgtattctggaaggtaagagaaggtcaatgacatagaaaatctgtttgacaaaataatagctaaatacttcccaagactatcaagagatttagacattaagatacaggaagcaaataaatccccaaatagattcaattcaacaaaatcttctccatgacatgttataatcaacccgtcaaaagtcaaagacaaagagaattctaagagaattatcttagtagcaagagaaaagcacctagtcacatatataagggtttaccatcagatttacatagtacttctcagcagagaccttacaggccaggagaaaatgggatgatatattcaaagtgttgaaagaaaaacaaaaatctgccagccaagaatactctataatctgcaaagttatccttcataaatgaaggagaaataaagtatttcccagagaagcaaaagctgaaggaattcattgccactgaaccaacactacaagaaatgctcaatgggagtgctaaacctagaagcaatagaacagtatataccataaaacaaacaaacaaacaaacaaaaaacgtgagaatataaaacttactggtaaacacacaaatgagcaaaataagagtcaaatgtcaccactacagaaaaccaccaaaatcacaatgataaccgataagagagaaaggaacaaaagatatacaaagcaaacaaaaacagttaatataatgagaggtatatgtcgtcacctatcaataataaccttgaatgtaaataaattaaatttcccagttaaaatatatagaatgactgaataatgagatcaattatataagatagaacaattctaaatatgtatacactcaatactgaagcacccagatatataaagcaaatatatcaaatcaaaaggaagagatagactccaatacaattatagtggaggacttcaacagcctaccctcattagacggatatcgtcagaaaatcaaaaaaaaaaaaaaaaaaaaaaagaaagaaacattggctttgaaatgctctgtaggccagtgcggtggctcatgcctataatcccagccctttggaaggtcaaggcaggtggatcacttgaggccaggaattcgagatcagcctggccaacattagctgggtgtggtggtgcatgcctgtaatcccagctactctggaggctgaggtaagagaatcacttgaacctgggaggctgaagttgcagtgagccgagatcgcaccattgcactctggcctgggttacaagagccaaactccacctcaaaaaaaaaaaaaaaaaaactcatcctttttatggctgcatagttttccatggtgtatatgtgccacattttcttgatccagtctatcattgatggacgtttgggttggttccaagtctttgctattgtgaatagtgctgcattaaacatacgtgtgcatttgtctctatagaatgatttataatcctttgggtatatacacagtaatggaattgctgaattgctgggccaaatggtatttctggttctagatccttgaggaatagccacactgtcttccacaatggttgaactaatttacactcccaccaacagtgtaaaagcgttcctatttctccacatcctctccagcacctgttgtttcctgactttttaaagattgccattctaactggcatgagatgatatcccattgtggttttgatttgcatttctctaatgaccagtgatgagctttttttcatgtttgttggctgtataaatgtcttttttttgagaagtgtctgttcttatccttcacccactttttgatggggttgtgtttttcttgtaaatttatttaagttccttgtagattctggatattagccctttgtcagatggatagattgcaaaaaactttcccccattctgtaggttgcctgatgatagtttattttgctgtgcagaagctctttagtttaattagatcccattggtcaactttggcttttgttgccattgcttttggtgttttagccatgaagtctttgcccatgcctatgtcctgaatggtattgcctaggcttccttctggggtttttatggttttaggtcttatgtttaagtctttaatctatcttgagttaactttttataaggtgtaaggaaagggtccagtttcagttttctgcatatggctagccagttttcccaacaccatttattaaaaagggaatcctttccccattgcttgtttttgtcaggtttgtcaaagatcagatggttgtagatggatggcattatttctgaggcctcagttctgttccattggtctatatctttgttttggtaccagtaccgtgctgttttggttactgtagccttgtagtattgtttgaagtgaggaagcatgatgcctccagctttgttctttttacgcaggattgtcttggctatccgggcacttttttagttgcatatgaaatttaaagtagttttttctaattctatgaagaaagtaaatggtatcttgatggagacagcattgaatctataaattactttgggcagtatggctattttcacgatattgattcttcctatccataagcatggaatgtttttccaattgtttgtgtcctctcttcaacatatgcaaatcaataaacgtaatccatcacataaacagaaccaatgacaaaaaccacatgattatctcaatagatgcagaaaaggccttcgataaaattcaacactgcttcatgctaaaaactcccaataaactaggtattgatggaatgtatctcaaaataataagagctacttatgacaaacccacagccaatatcatactgaatggacaaaagctggaagcattccctctgaaaaatggtacaagacaaggatgccctctctcaccactcctattcaacatagtattgaaagttctggccagggcaatcagacaagggaaagaaataaagcatattcgaataggaagaaaggaagtcaaactgtctctgtttgcagatgacatgattgtatatttagaaaaccccatcgtctcagccccaaatctccttaaggtgataagcaacttcatcaaagtctcaggatacaaaatcaacgtgcaaaaatcacaagcattcctacacaccaataacagacaaacagagaaccatatcatgagtgaactcccattcacaattgctacaaagagaataaaatacctaggaacacaacttacaaggggtgtgaaggacctcttcagggagggccttttaagaaagtataagaaacagtgttgagacaggcctgcttcagagatcaatagtacatttgtataattggagaattagaggcaaggtattgggtctcactgaaactaaatggtcttaattggatcttgagtggttttctgtcataaaaacttattgatcttcaccactttccacccagaaattaaaacaccaaatggaacaactccatatgagttcagtctttcaattagagcactctaccttatgaagatttagaaattagttgttgaatcttttatgaaatataaggtgcttacagcttggtactttcttcaggtaaatataagttcaaacatcccagtttttctgaaaatagcaactattttattagggctcaatttattatatcgactcatttagtgggaagacctctggcattctaaacaattttgaacatactcataaacctagaaaatcagcaaaaaagctacccaaatgccaaagtaatgctttaaagtgcaagcacttaattccataagaaaggttttattcagccattacaaactctttatatactacacaaaattatatccaggctctgaaaacaccttctttcccagatcgactgtaattatcttcttttaaacaaccatcagtgattacctaatttctaaaatagccctcctaactggtcttcctgtttctacttgttccttcttatttttttctcaacacaatattcagggttatttttaaaaaatgtaaagctccatcatatcactcctaaactcaaaaccctccaatgctttctccattcaatcagaataaaagccaaaaattttgaaatgtctatctaaggccctaaatcacctggactctgattacttcttgatattatcccttttcctttctccttgcctcactcttttaaaaacatgtggactttcctgctgctccttgaacccaacaagcttgcttctaccttagagtcctttctctgggtgatctgtctacatcaagagctcttccctttaatttctacacaattccctccttcactgctttcaggtgtttgctcaaaagtcaatatctgaataaactttccctgagccagatgtttttaattatattacccttattatccctgaaacctccattccctttcctactttgttttcctctatagcgtttatcaatatgtgagatatcatctattttatttggcaagtgtttgtcttgctccatttgaatataagcttcataaaaacatagattttctttttcttttttggttgctgctgtatcccaaaaaaagctaggccagtgcctgacatatacatgcaatatatacttttgcatagaaagggaagaaaataaaaaagaaagcgaggaagaaacagagacagtaagaatatttccgtatgtgcagcacttacatgtatatatatgatatatagatattattcaagttttgctgccaaattaaactttctaaaaggttataagtattttgaaaaaaaatctaatgcatgcctgataatctcaggatgaaacgtttagcaaactttttcactatactgtcgcattctgccacatacacaataaattccctaaacacgccatacccattcacatgttactccagatatacctaattgtttacagcttcataagtacaaagtaatatttcaaacattagtgctttacataagatgttcttacttccaggaatcccatttcccttgcccttcagttaaagaactcttatttgtatgtcctaggtaagtcctttcagaattcattttaaaattttcttggccgggtgcagtggctcacgcctgtaatcccagcactttgggaggccgaggcgggtggatcacaaggtcaggagatcgagaccatcctggctaacaaggtgaaaccccgtctctactaaaaatacaaaaaattagccgggcgtagtggcgggcgcctgcagtcccagctatttgggaggctgaggcaggagaatggcgtgaacccggaaggcggagcttgcagtgagctgagatcgcaccactgcactccagcctggccgacagagccagactccgtctcaaaaaaaaaaatttctttttaaaattttatgggtacatattagttttgtacacatttatggagtgtgtgtgatatttgtatacaggcatacaatgtgtaatgatcaaatctgggtaatggggactctttaagtactgcctttatgattgtcatccatgcttgcctctgtcacagcaataatattcattatttcaaattaatttgtgtctccagtatactaagcagtaatacactccattttaatcaccttcttcctttcctggtaaatcctatagtcccactacaatacttgagataaatcagtctgtaattttactaagtgaataaaaaagtaagtaaaaggattcctttttgaatgacaagttacatttatttaggcgaacaagatagagtagcattagtacatgataaatgtgtttcatatcgctgggaaacatagacattgtttaataaacattagccattttaagaaaaaacttacattaaaccacataatgaaataaagtacatgctaattaaagattttaatatcgataataaatacattaagatattaaagattaaatcagtttttcaaatcttgcagtagagaaagctttcatgaaaatgacaccaaagggaaattcacaaaagactaacagatttttttactatgtaaaatttttatgcatcgaaaaataaaaacaaatgtaccatattcaaaaagaaacatataagagtgaaagccataatgatcttattatgtaagatcctgtatgaataagttaaaaagtattccatgtagaaaacaaggaacatgaacagataattctttttttatatatactttaagttctagggtacatgtgcacaacatgcaggtttgttacatatgtatacctgtgccatgttggtgtgctgcacccattaactcgtcatttacattaggtatatctcctaatgctatccctccccccatccccaccccacgacaggccccatgtgtgatgttccccttcctgtgtccaagtgttctcattgttcaattcccacctatgagtgagaacatgcagtgtttgttttttgtcctcgtgatagtttgctgagaatgatagtttccagctccatgtccctacaaaggacattaactcatccttttttatggctgcatagtattccgtggtgtatatgtgccacattttcttcatccagtctatcattgatggacatttgggttggttccaagtctttgctattgcaaatagtgccacaaaaaacatacatgtgcatatgtctttatagcagcatgatttataatcctttgggtatatagccagtaatgggattgctgggtcaaatggtatttctagttctagcagggatgccctctctcaccactcctattcaacatagtgttggaagttctggccagggcattcaggcaggagaaagaagtaaagggttttcaattaggaaaaaaggaagccaaattgtccctgtttgcagatgacatgattgtatatctagaaaaccccatcgtctcagcccaaaatctccttaaagtgataagcaacttcagcaaagtctcaggatacaaaatcaatgtgcaaaaatcacaagcattcttatacaccaataacagacaaacagagaaccaaatcatgagtgaactcccattcacaattgcttcaaagagaataaaatacctaggaatccaacttacaagggatgtgaaggacctcttcaaggagaactacaaaccactgctcaacaaaataaaagaggatacaaacaaatggaacaacatcccatgctcatggataggaagaattaatattgtgaaaatggccgtactgcccaaggtaatttatagattcaatgccatccccatcaagctaccaatgactttcttcacagaattggaaaaaactactttaaagttcatatggaactaaaaaagagcccgcattgccaagacaatcctaggccaaaagaacaaagctggaggcatcacgctacctgacttcaaactatactacaaggctacagtaaccaaaacagcatggtactggtaccaaaacagagatatagaccaatggaacagaacagagccctcagaaataatactacacacctacaaccatccaatctttgacaaatctgacaaaaacaagaaatggggaaaggattccctatttaacaaatggtgctgggaaaactggctagccatatgtagaaagctgaaactggatccctcccttacacttatacaaaaactaattcaagatggatcaaagacttaaatgttagacctaaagtcataaaaaccctagaagaaaacctaggcaataccattcaggacataggcatgggcaaggacttcatgtctaaaacaccaaaagcaatggcaaccaaagccaaaactgacaaatgggatataactaaactaaagagcttctgcacagcaaaagaaactaccatcagagtgaacaggcaacctacagaatgggagaaaatttttgcaatctactcatctgacaaggggctgatatccagaatctacaaagacctcaaacaaatttacaagaaaacaacaaacaaccccgtcaacaagtgggcgaaggatatgaacagacacttctcaaaagaagacatttatgcagcccacagacacatgaaaaaatgctcatcatcactggccatcagagaaatgcaaatcaaaaccacaatgagataccatctcacaccagttagaatggcgatcattaaaaagtcaggaaacaacaggtgctagagaggatgtggagaaacaggaacacttttacactgttggtgggactgtaaactagttcaaccattgtggaagacagtgtggcgattcctcaaagatctagaactatgaacacataattctttaaaaaatatagatggctgcaaaaaaacgtaagaatacagctatctcttcaatatattgattttctttcttttgggtatatacccagaagtgggattgttggattatgtggttgttcaatttttagtgttttgagcaacctccaaactgttctccatagtggttgcactaatttacattcctaccaacagttttacgagggttcccttttcttcttatttttattatactttacgtttcgggatacatgtgcagaacctgcaggtttgttacatagctatacacgtaccatggtggtttgctgcaaccatcaacccgtcatctacattaggtatttcttgtaatgtattgcttgtcttttgaatataaaccattttaactggggtaagatgatatttcattgtagttttgatatgcatttctctgatgatcagtgatgctgagcaaattttcatatgcctattttccattcatatgtcttgagaaatggctattgaaatcttctgcccattttctgatagcaatttaagacttttcctatagagttgtatgagctcctatattctggttattaatcccttgtgagatgggtagtttgcaaatgttttcttccattctgtgggttgtctcttcactttgttgactgtatccttgactgtgcagaagcaacctaaatgtttattgacagatgaataggataaagaaaacgtggtacatatacccaatggagtactattcagccataaaaaacaatgagatctagtcgtctgcaacaacatggatggaactgtgtattattttaagtaaaataagccaggcacagaaagacaaacattgcatattctcacttgtcagatctaaaaattaaaacaattgaacccatggacatagagaataggagaatggttaccagatgctggaaagggtagtggaaggctgggcttggggtgagcatgattaacaggtacaaaataaatagaaaaaataaataagacctactatgtgatagcacaatagggtgactatagtcaataatagctgaattgtacgttttaaaataaagaatataattggattgtttgtaactcaaagaataaatgctcgaggggatggatacccaattcctcatgatgtgcttacttcacatggtaccccttaagtatatagatctactatgcacccataaagataaaaaataaaatatatagatggtaataaatacataatgtggactccaaatacaaatcaaagaatacacacatttaagggatgtcttttttcacctatctaacttactaaaaaattaatgaattatatctaatgctggatataatatggagaaagagcgggtagaaacatctagaccatgttttcaatgcaatttggtagtgcttgtcaagtcttaaaaatatgtgtttccatgaaatccagacatcataatttatcataaacatgagctagtatccaaaaagtttagcacactgatattcataatccggaaaattgtaaatgaattgtccagcattgaggtattcattaaatagatcggtatatccactcactggaatattaatacagaggcagtacagcattgtggttaaaagtcaaactgacgtatatctgactccaagccttcccatgtactatctgtgggcctctgcacatttttcttaacttcttagcttcagtggtcccatatataaaatggaaataatactggaacataatgcataggttcgtagagaagattaaatacatcaatgtttataaaccacacagcacagtgatgcataataagtactatataatattattaaaatattgaggagaaatatttcatgacttggaaatatatttgcactttattatggggagaagcattataaaatagataaaaattttttaatgaaatatatatgtctcaaaacgtttaatccatattattgtccatatctggattttttgagtataagctttcctcttcataaagcagtgtgactcttcaaacacaagaatatttcaggtgtatcaattaatcagctaggactcagtaataatttacctattatatacaaatggtttctatgcttggaatgaaaaatcaggaattagaaaacaggagatttaatgtccatattgatgtctatatagaccacacttttctgctttcttctagaaattttctttaattttaaaattgtaatctttaatttattaaattatttaaatctatgttcctcaagtatccaatattctcaggtaacatatattgactttcaaactgataagtttataggaaaccaaaatataaaacattaagaaaaataaaaatctgagtgtatatagcttatttggaaagcacaaagcactagttggacaatgggtacagagaatgaatgacaataaggagggatatggtaataagtaacatatcacaatagttgaatggaaattagtcatgttttaaaccctaccaaaggtataaaatctttctcagaatctttgcattggaactgtgatggaactttcaagaaacatcgaggttgctcagagggataatttaccaacactttaggctagctatgtgtgtcaacagagcaacttttgatggttccaaagggtaggaaaaaaattaaagaatttttaagattaaaatatatatgtccatgagctagacaaagatttcttagatacaaatttattaaaagtgcggagtattttttaaatgacaaattgaacttgttcaaaattgaaaaccattgtttgtcaaaagacaccattacaaaaattaaaagatgacatcagtaaaaattgcagagtaagtaaatacaaactttggccctccataaaagcaacaacaaaatctaggaaagaactgtctgattcaacttttacaaactttataaattaagtaaactatagcagcaaactggggaatcgttattcaagaaataaggcttatttttggtaattacagctttttttcattttgtgatgttttacgttacaccattcccattatccatcatccacttgccagctcagcagaaagaccagtgcacattcctggtaccaaagagagaagaccagaccacattcaaaaaactcagaactaatttcatgttgtgacatgtctgggactgagaccagtgggataccatcaagtagaaaaacacacacataataaatacccagaagaagaagagaaagataattcatcaggaagatataataattataaatgcatatgcacctagcaatagagcctcaaaatacatgaagccaaaactgacagaatttaagtgagaaacagttcaactaacattactgaagacttcgataccccccattcaacaaggaatagaaaaactagacagatcaccaaataaacataaggcttaaagaacattatataacaactatacctatacgtaactggtatctatagaacattcaatccaaaaagagcatatttggataattcataaatatgttataactaaaacaatctattcccaattaattaataagacaaggaagaaattataatggaaatcagatgatactctgaaaagaataaaaaccaagactaaaatacaatatacataccaaactttggagattcaggaaagcagtgctcaaggaaatttcttagctggaaatgcttttatttaaaaataattaagatctcaaatcaatacctaactttacacctgacaaaactagaaaaagagcaacctcaaccccaaattaaagaaaggaaggataaaggttagaacagaaataaatgatatagctaactaaaaaaataatatgatcacaaaaagcaatagttggttcttggaaaggtaaacgcagttgacaaaactagctattctgaccaagaaatgagagagagacagaaagagtgagagagagaagaagaaaaaggaggaggaagaagaggaagaaaaaggaggatgagaaaggaagaggaaggaaggagggaggaagaggaggagagaagagagagacagacaagattcaaattgttaaaatcaggaatgaagtggggaacattaccaaccaccttacggaagtattgttaaacatacacttaacatatgatccaggaatttgaatttggggtatttatccaaagtaaatgaatatgaatttccacataaatcttacaagctaatacagtttgaatattcataatctgaaaatccaaaacctgaaatgcttcaaaattcaaaacttttgaggcattgatacgatgctcaaagaaaatgctcactagagcattttagacttcaaatttttggattaggaatgctcaaccagtaagtttaaaatgcaaattttgtaaaatctgaaatttgaaacacttctgttgccaagaattttggataagggatacttatcctgtatttatagcagcttgattaatagtagctgaatatatgaactatcccaaagctccatcagcttttaaagggataaagaacatgttaaattgatagaatagcaactatggaagaaaactcaaaaacattatgttaaattaaagaaaccagatacataagataacatatataatttcatttaaattatatcctaaataagtcaaatcattagtgacagaaagatcagagattggttgtgtcaagaggtggagattgattgcgaagcagaaagagggatgaggaaattttctaaatcattattatggtgatgacataatgtgtttatacatagaaaaaaactcattgatatgcactgaaaattcatcaattttaaaactataccccactgtaatcttagcactttgggaggccaaggtggcagattgcctgagctcaggaagtcgagaccagcctgggcaacatggtgaaaccccgtttctactaaaaatacaaaaaaaaaagttagctgagtgtgatgtacatgcctgtagtttcatttactcaggggactgaggcaagagaattgcttgaatctgggaggtggaggttgcagtgagctgacattgcgccactgaactccagcctgggcaagagcaagacactgtctgccccccaaaaaataaaaacaaaaaaaacaaaaaaacaaaactataccccaataaaactgttaaaaatatcacttacaaattctgccatcaaagtagatacctaccctttgaaaatgtgagtttgccactcttttaatcaagagatggattttatttccccacagcttggttttgggctggatcacataatttgctttggccagagatacaagaaatgatacatattcagatacttaaagagttctgcatttggtattgcccccaacttactgctgagaccatgaaactatcatgtgatggaacccaggcaaacttactgggtgatgagacaatcatcaccccagctgacactagagtcctacaatcttatcaatatattcttcagccccagctgacccaggctaaatgtaagtgatcactcagccaactcacataacctcagaaacaataaatcttggtgttttaaaccaaggactcacaatcacgatggaaggcaaaaggcacatcttacgcggcagcagacgagagagagcgagagccaggtgaaaagggaaacaccttataaaaccatcagatctcatgagacttattcacgaccacgagaacagtatgggggaactgcccccatgattcaattacctcccaccaggtccctcccacagtgtatgggaattatgggagctactactcaagatgagattttggtggggacacagccaaatcatatcattttacccctggcccctcccaaatcccatgtcctcacatttcaaaaccaatcatgtcttcccaacagttccttaaagtcttaactcatttcagcattaactcaaaaagtccacagtcaaaagtcttatctgagacaaggaaagtcccttctgtctatgagcctgtaaaatcaaaagcaagttacttagttcctagatacaatgggggtacaggcattgaataaatactcccattccaagtggaagaaattggtcaaaatgaagaagataaagtccccatgcatgttgaaatctagcagggcactcaaatcttaaagctccaaaatgatctcctttgattccatgtcttacaaccaggtcatgctgatgcaagacgttggctcccatggacttgggcagctccacccttgtggcttttcagggtacagtcccactctttgctgcttttatgggctggcattgagtgtctgcaacttttccaggtgaacagtgcaagctgccagtgaatctacaatttgggggtctggaggatggtggccctcttctcacagctccactaggcagtgcatcagtagggaccccatgtaggggtcaaccccacatttcccttctgcactgccctaccaggggttctccatgacggccctacccctgcagcaaacttgttcctggacatccaggcattttcatacatcttctgaaatctaggcagaggttcccaaaccccaattcttgatttctgtgcacctgcaggctcaacaccacatgtaagctgccaaagcttggggcttgcaacatctgaggccatggctcaagctgtaccttggcccattttagccatggctagagcagctaggaagcagggcaccaagttcctaggctgcacataacaggggggacctgggcctggcccaaaaaaccattttttcctcctaggcctctggacttgtgatgagaggggctgccacaaagttctctgacatgccctggagacattttccccattgtcttggagattatcatttggctcctcattacttatgcaaatttctgcagctggcttgaatttctcatcagaaaattgtttttttttttctatcgtatcatcaggctgcaacttttccaaaatgttatgctctgtttcccttttaaaactgaatgcttttaacagcacccaagtcacctcttgaatgctttgctgcttagaaatttcttccaccagataccctaaatcaccttcctcaaattcaaagttccacaaatctctggggcaggggcaaaatgccaccagtctctctgctaaaatatagcaagagtcatgtttactacagttcccaacacgttcctcatctccatctgagaccacatcagcctagatttcattgtccttatcattatcagcattttggtcaaagccattcaaaaagtctctaggtagtaccaaactttcccacattttcctgttttcttctgagccctccaaactgttccaacctctgcctgttacacagttccaaagttgcttccacatttttgactatctttacagcagcaccccacctcttgcaccaacttactgtattactccactttcacattgataaagacatacacaaggctggctaatttataaagaaaaagaggtttaatggactcacagttccacgtgagtcataatcatggcagaaggcaaaaggcacatcttacatggtggcagacaagagagaatgagagtcaagcaaagagagaaacaccttatgaaaccatcagatctcgtgagacttatttactatcacgagaacagtatgggggaaaccacacccacgattcaattacctcccactgggtccctcccacaacatgtgggaattatgggagctacaagtcaagatgagatttgagtggggacacaggaaaaccatatcaaccctgtcctactaatccgaaagggtgaatatatcgctacccaatacaatgttacttgaaagtcatgcaactaataacatcattattctcttcctagtgcctcccaattgtcctgatggaaagggacttgtcataggtgagtttcattttttgttgtcaacatcatgtttactggagtttagattacaagagaagtcatactttttaggtgtacagttctgaatttaaatatgcattcagttctgtacctctaccaaacacagaatatagaatatttccatcacttcaaaacattatcttgtaccactctgtgttaattttccaaccctactgtcatcttttaggaaacagacaccaaaatataacaggaaaaattatatagtcagaaagtagaatggaatttttacaggatttcttgtttaataggtatggagattctgtttggaatcaaaattttatgaaattggatattggtgatggttgtacaacattataaatacacttaatgccactgaattgtacacagataacaatggttaaaatggtaaattttatgttatatacattttaccataataaaaatcatatttgccttattttaaatttatgtaaattgaatcttatagggtatactttgctatggctggattattttgttcagtgttatttgtacagttcatctatgtcagtacatatcgttggagtccatttatattcattctgttctgtgaatatagcatgatttacatattcagtttattgctaataaacattttagctgtttctggtgctggactattccacataatgctgctatgaagcaatattttagattccaaaataggaaaaaaaataaacttagcttttgccaccacaaattgtagataaatgaaatcaattaccataattctcggtcaataatttcagagattactgagtcagcataagcaatcataaagtgtcctatgtatatttattaatatacttgatttaattatttctaagtaacttttagcctatacccgtttttcatttttacccttgttcatatttgattggtataaatgtgtgagaatattaaggtatcttccctagattcttgcttttgtcccaaataccacattactgcactctaaaaattaggttcaaacttcaaggggagtgagtatattttgctggaagagtttgctctgttgcccaggctggagtgcactggtgtgatcttggctcactgcaacctccaccccccggattcaagcgattctcctgcctcagcctcccaagtagctgggactatagatgcacagcaccatgcttggctaatgtttgtattttgagtagacagggtttcaccatgttggccagactggttctgaactcctgacctcaagtgatccacctgccttggcctcagaaagtgctgggattacagatgtgagccaccgtgcccggccctcgaaatcttgtttcaggattcaggcaagtactatacttgtatgatatatttatgtaagtgttataataatggagacttacatattttacatatacatacatgcagtgttttggttaattgttaaatatatctgtcctcaggttgaaaagtggtttatatagtcttgtgatttttagaattcttctaaattttgattccaagactgtattttgcaagacaggttgtcaatgcaaccctgtcaaatttatatatagagacacaaatctaattttcgtttttttcaggttttattgcctctttagagtaaaaaagtaccaactttttggaaagcattttattcactcaaattagcttctgaaccttattgcatccactttaggctaaatctgctaagttaacattggcatgtctttgcaaacacttccatgatgatggtttggaaaagatgtgttgactttcaattctaaagttactaagtgtggaatccctgatctgcctggccacagcatcattcatcatctgactaaattcacatgaatagagataactatattaattacaaatactacaaattttaactagaataaacaaagagaaaggtgactgcatgacatataatagccaagactgcaattcatgtgttaggtgtttatacagtacttcatacagtatttaatatatgaaacattgggttgagggatacttttaaattttgttttcagccgggcgcggtggcttacgcccgtaatcccagcactttgagaggccaaggtgggtggatcatgaggtcaggagttcaagaccagcctggccaagatggtgaaaccccatctctactaaaaatacaaaaattagccaggcacaatggcacgatggcaggtgcctgtaatcccagctactcgggaggctgaggcagagaattgcttaaacccgtgaggcggaggttgcagtgagccgagagcaagccactgcactccagcccgggtgacagagtgagtctccatctaaaaatatatataaataaaatgttttaaaaaagtttttactgttagtacaaggaagtaaacatgattaaagctgaatggctaggaagtgagctctaataacataaaattgagaaatacactgctttccccttttgaaattggaatgaaatttaatttgaatacgccaattacctagcactttgctataaagcatactagatcttgaaaaaaattctaacagggaagaaatgaaaattgccgacatatgctatcttggcattcccatagatataagatgaattatgattttttgttttcataatatgtaagttaatgttagtattcctagctttgcaatacctgtgtgacctggtatttatgaggaattgtttccaggactgctgtagataccaaaatccacaaatcctcaagtctcttatataaaatggtgtgctatttgcatataacctacgcacaacctcctatacacttcatctctagattacttataatacctactaaaatatgtaaatgctctataagtagttgttatactgtattggttttacttgtattttttattattatagtgtttttattgtttttgcctgaatatgttaaatctgaagtgggctgaatccatggatgcagaactcacaaatactgaagggcgactttattttaaaaagtggaaatgtaataaattgataatcagtctttgtgcatttgctcatactggattttaagtaattacagaaacaagaatacagaactttcttagtcttaaaataattattcagtagcttttccagtaatctttaaaagactaaacctattgataagtatattgttgtttaaaattgcataatttattgtcaaatatgaatcgctaaatatcttttctataaaatcattctggcatacttgtagcttttatcaattaattatgtcagctatttattagctaagagattgtaactccctgaaatagcctcacaaatatagccacagatatcatggttgtagacaataagcggtatttagtgattgaaacaatatatatcttagcaaatatgctacactcttcactctagccatggctctgtggaaaacacatctgttttcttctcatcatgtcacattatctcttatatccattggttcctcattaaaaggatgaagaaaaaaatagtaccctgtatatacaaacttatactacaattcttgaagcttattaaattttcttataaatatttcttaatgacaaagcattatttccagtatatacagtgcctcatatggaggattcaacagcaaagttcccaagggttgtagaattattgcttactctgctaaatgatcaagaataacctttattaagcaaattatgtttagagagatattactctctatccccactaatgttaattttctgatgtcaaatggatttgaaaagtgcggctaactctaactcttggaaattaacagaacagattaaagattgttaacagtctataataataagcaatttttttaacctaaatatcctcaagtattgcttagattcctcttttattacatagctaaacactaaagaattctagactaaaatattattatttaaaattattctcacattcttatgattgtttggtcttttatcaactattgccaaaaatctgaaataatacatatgtctaccccaacacttaatggcttaaaataatagccatacatgggttagctagacttgggctgatctttgccaggatcagtagagtcagttatgttctatgtgtctctcatcttccttagcctaatagtttagcagaataagttcatttcatggtgatagaagaggcacaacagagcaaacaaataccaaggcatattaaagcctaggtttggaactggcacacttttactattgtttcattctatttctaacgtaagttacatggccaagtacaaagtcaagggagcagggaaacacactctgcctttacaagaggaactatggagtcacacaaaaatactatggaaataagaagagatgaaacattaagatcaataatacaatttaccataagtcttttctctcatttcaggctgtcagctgtcaagtcaactggtataattgtgaatgtttctaatgtgcttctaataagatttatttaggaatttaaataacaaaaatgtacgtaaaaataagaattcacaagttctcatcagacgctgtgtggttttcttgggaataagtttcaacatacaccatccataaacttggtggcttatagtgtggtctgctcagggtatctatttatttactttctggaaatgaaatgatgcctgaagcttagctccagatatgaatattttttactatcagcttacttttctttttttccacttcgtaatttctgtttaattaattattaaaatgaggataagtcaaggaggatatcaatgaatagaaaattttgtgagccataattatacataaaccatgcaactctggaatctacaagaatacagtagattattatttttaaaaatcatttacttttttaatttcgtgtaggtggagttataattttccactctattgactttggacttggccacaagacttattctggccaacggacagtaagaaaacatgatgtttgaaacaaccaaacagaaatgtttaaagacattacaaatttccatttgtgtacgtcttttcagttctctacatgaagtgaacaaattccaaatcagagctcatcattcagtctgagcctggaagaaaaagatacatgaaacagacttgattccaactcatagtcagaagtgagtggagcaataggcatgtaacaggagagagaaataaacaaccgtccttttgggacactgagatttgcagttgtatcttatgtatcatcatctagcaaaacagaataatacacaagatttatatatcggaatgtgggaattctttataattaagtagctaggatgtaactgagtgctaaattagtgcagaacaaaagaaaatctgagaatacatagaagactaaaagaaacgaatattaccttcttaatctcttcactgctcattttgtgccttgcttaggtgtcactattgtctatattttatagaaaattgaaaaaaatgagttaattagatcatgtatttggattgctgagaagtcttttttaaaaatacttttgtcctataatactaatacctgggtactatgaaacaataagtacaacaaaccccagtgacacttgtttacctatgtaacaaaccttcacatgtatccccaacccaaaataaaagtttaaaaaaaaagaaatattaaaaataaataaatttgaaaaaaatactaacataatcttaatataccttagaaatccaacattttggttttatgcatcatgttttagacaattttttcacaattaaaagcagcccaagataatcatcagactcagtttttgatacattgcttgcacaatttggtatgttcatgagctgtattttagcaacaaacaaatcaatttcacatttggaagctttcacatttgagttaactgaactctgtagcctcattaatccttaatcttaagaaacaaacaaaacaaaacataaaatggtaaacaaccttcaacttaccatgtacatgtgttgcactatttgagaggaaaactctagtatacttagcttttcatttggggctcaatgtgccccattctacttttctattcttccacaacatgaactttcataggcattactaagaaaaagttaaaccacatgatttgctaatttaaacatatttaaacatttaataattaaattaccatatacatagcttaatatattttgtattatagatcttcactggtaagtagattatggttaaaggttcctatatgtcagtagttcttaacttttagggattagccatcgttttgaaaatacaaatataaatgttcttttctttagcaacgggctaggagccagacaaaaatgactgagaaaagaaaacaatgtagaaaactctacatagccttttaaaaatagagctcagtggacgctttgctggctacttcctaggtaggataaatactgcccatctcttactagaaaaacatagatttttaagtgacccaatgttcctatgagaatgtacattatttcacctgctagaattctcttgtaaaatgtagaagaaaaaaattaattgaaaaacacatagatccatgtcccttcatctaaaactcacacctatgattcacagaaaattactaggctaccagccatttcagattttgatgctaggcacaaattccctgcccgaattcactgtatcactacatgaatatacgtcattagccacataaattattttgaactgaattatagtaaattatacagtattactgttcacatagcttgaaaagtgttttctgactcattcttataacttattctacataagaaaataataagtttagagagatttaagtataaagcattatttttaaaactctttacatgagggcaaacatttgttaatattatctaattattcctcgaaataaattctttggtaattcatttttgttttttagaaactaaagtcttagagttagaataaaaaaaaaagcctgcaaacagaaacaatgtattttcaagtgttatttttcagatatattgcagtgcattttaattttataaagtcaaaagaatttataagtaaataaactatccaatgtcactttctgctatcctgaataattatcaataaatgcatgtattcataatgctcatttgaatatgaatgggagcctgtcagggaatagcttgtatgtccatttcagttttacacaatgggaggtacgtgatcacacataacgtacttcaccagaataaggagataaagctgtaagatgtcccttgaaattaaaagatttctcaacacaaaattctcagattcatcatccacaatcaatgtagatttgtttataaattggttttagcaagactcctcacgttaagtcatgccacatgtaaaataacattccaaacagtaggatggctgtagtgttggagaaacagaacaatctaagttttaatctcacttttgtgattgactaaatttgacgtattgggttatttaatattggagtgcccatctctttatctaaaaagggaaaatagtaagttaagaattcttacgaatattaagtaacatgtttctcatcacaatacagtagataccaaaatcatgtcacagacatgttgtgttagaaaaccagatctgatccagtgtacagtgtagcaataggtagcggaagtatagaagttcaagcctttgcctttactttcaactcctaaaatagttcacttggcattttccccctgggttctttaaatatgccttatactctggtgtatacaaatgtgtgcccctaccttgcaactactcctaaaacagaaatttgataccaggactgagtttggagccctgaaatcagttactaccagcaaattcctaaagtccccatcaacatgtttacctatctgaaaggatgctccctttctacttttttctgatgatctgtatggattctcttcctatcacatattattctcctttatggaaactgtgttctattatttgtgttatattgtttatctcctgataactatttgttacaggatgtgcctcagcattcttaccttaaaaaccaatgggatttctaatctcagagtcacagctgagtgcgtatacattcaatgattttatagctcatgctggttttcctattcatccatgatttttgaaaataaggattctttctaactactactcactggttgaacaccttaagcaatctttatctagggtacaatgctccagatattaacccttattatcctttataataaggatataaattatccttctattacttcccaaactctgttgtaatctgttagtctattttaatatacttcaggccctgggaaaactagtgaaactaggtaggaccatgactttgacgatcacttgatatacaaggtaagatccaaaagcaaaaaattctttcaatactgtgtctgctattacttaactcatttttcttttatcgataaataatgattgtgaaaactaactgaaactgcccatgtgaaaatgagtagcacagatcctagttcatataattagaatattttgaaagacagacagaaaccggcccttatcttaaagtgtttaaaatcctcttatgagagatatgtagaacagcaatcaaccatatcataatgcaattaataaataatgaggtgctagttgataagctacagaattcagcaagtaacaaatattcaggcaatttgtctttgagatacatgtgcatactagagatttaaatatgatgataaaaataaatgaagaaaacacatgatgaagaagaccttacaaagagtaattaggaagatgtgatactaaaatcactaaaaatgcaatacagttatccctttgcatccatgaattccgcatccatagcatcaaccaaccaaggatcgaaaatatttggaaagaaaattcctcctgtatagacgttttttcttaccattattccccaaacaatacagtataacacctttttgcatatagtttacaagtaatctagagataattaaggcatatgggaggatgtgcataagttatatgcaaatactatgccattttacatgaaagacttgagtacccaataattttggtatttgtgcgaggtcctggaagaaattcccccagagatgctgagtatttcattcttattccttttattaacgtgacttgctaaaagtttaaaatatatgatctgattaaacttctaaaattgtctagtaaaaaataaaaaagacaaaaagtaaaatatcagatataaaaggataaaataattacacattaagacaggttagaacataaattaaaagataaatgaaaataatgaagatgttaataactacaagatcaagaaaaagacatcagttaggtaggttagaggccttaggaaaacatgaaacttaatggtcatacaataaatatcataccattttaaagttctggatcttaagcttttggcaaaatttatacacacttcttacatattcatatacatatttgattactgaaaattgtgtgggaactctattatcatagtcctccaaatcttaccctttatacattttaaacttattagaaaaagagataaatatatagtactatttctaaaaggaaaagaaacccaaaatatgtacaattgaaatcatagattgagtgctattcccccaagtttccaaattttttacgtatgttacattttttttttaatcttgaaaagccaaaaatgaacatactattatcttgaattatttcagtagatttgcctcaaagagtttaaggttcatgctggtttgcctatctagctataactttgtacaatggggtttctaactactgctcattgatagttcacctcaaggttgtttaactaccatgccaatatctataggcataaatctgcaagtattaagagttacagggttgtcctgaatttttaaatgatttaatgctatttgctttaatcttctgttgcagtgaactttaaatcctccaagcaaacatctattgattataaacaaattataaaatcattgcactaaacttttgtcaaccatattgtagacttcttttcaagaggagaagatattactaaatattatctgatgcattatttctaaacatttgtcccaagaatgactgtaaattgacatctgctggaaacatattatatagacctttcaccaaaatcaaacatagcaatatataaatgtacacaaatccatctgtattcatgcacacatatgtgccttcttacatatatgcatatctgaacactgaaacacagactttcataattcctttattttcttaaaatcaaatttacacaaaagaaatatttgaacatgttcaacatgttgtcaactactaatataaaattttaatgcacagagctgccaaaatccaccaaaaaaggaaacctttaagaaatatttttttatattgtgatatcctgaggaaaaaaatcactgaatggcctttttcattactatttagtgtgataattactaggtgctagtcctccttcttccagataaatacagtgtggtaaaggagaatgaacaaaaatgtagatgactacagacaagattaatgaagacaacatcagagctattctcagggtgctgtggaaactgtctaaccaaaatttgcagaaatggtattttgaaaggcttctggaaggtataaaagttgaaatgagtcctgaaagataaataagcattatctgaggggaaaaagaaaataggtgaaggacaacccagagacttagacagcgggtattcatggagggtatgaaataagatggtcataatttagagacttcaagtagcacggtataaagaacacatgtgttttgaggtggataatgctgaaatacgatactgaagcagtaagctgggaccagtccagattaaacactctgataaggttgtgcattatccatatttcattagggggaattaaaaaataaaaccattagacagcaaaatgacacaatcatatgtgtgctttagaaggaaaaccctagtagaagcatggcatagagagcaaaaatcaagaaaaactgctcaatgaagatctgaaataaggtaggggttaacaaaaagaaaaatgtggggaagataaaaaaaaagtgaggcaaaaccttagaagtctttggtgaatgaaagtctttggtaactgaaagagttaatatacataaagagatggctctttggtgtctttaatggacatctagatgactaatgttactgtttgacgaattatagaaaatatgagaagacaagtttgcagatagagttaagtggatgagtacagttaataaagtgtaggtcttattatgctagagaacattgactttgtaatattcagtgggacattacagttctggagcttatgagatgagataaatcagaatggatttatagaactgaaggtcaaaaatgtagacaacagaatcactaattgaaatataaattgaataatgaagaatatgtagagggaaaaggatgattggaataaatctaaaagaaataacaatagttaaagttgagacaaagaaagtatagtcaagatacaaagcaaaataaggagagccaagaagatggaagaaaactaagggagagtgtttcttcataagtgaatgaagaaatttaaaaattttttaaaattcttgaaactaatgaaaatttaaacaaagcataccaaaacctatgactacagcaaaacagttctaaaagggaagactatagcaacaaacacctaatcaaaatatattagaaagatctcaaataaacgccttaaatgttaacataaagaaattagaaaaacaagagcaaactaaacccaaaattagaagaaaataaataataaagatcagagtataaatgaactaaacagagaggaaataacataaaaaatcgagtaaacagagttgttttttgaaaagataaacaaaataaagaaacctttagctcaagctcaactaagacaagaagcatattgaaatcagagatggaaaaagagacattacaagtgataccacaaacaatgcaaaggatcataatatactattatgaagaacgatatgcccaaaattgaaaatcctggaagaaatgaataaattcttggacacatacaacctaccaaaattaaatcataaagaaagtggaaatctgagctgaccgatagtgaataatgacaccaagaagcaataaaaaagtctctcatcagagaaaagcccaggaccttacagcttttctgatgatttctaccaaacatttaacgaactgatacaattttttaaaaactattcaaaaaaattaaagtggaggaaattctttcaaacgcattctacaaggccacgatcactctaataccaaaaattaggcaaggacacaatttaaaaagaaaagtaccagccaacatctctgatgaccatacaaggaaaaaccaacaaaatactaggacacccaatttgacaacatattaaaaagatcattcaccatgatcaattgggattcatcccagttgtacaaggatgatttgatatatgcaaatcaataaacacaagacaccacatgtacagaatcaagaaaaaagccaatatgatcatttcaatagatgcagaaaaagcacttgataaacatcctctgtgataaaaactcttaagaaattaggcacagaagcaatgtacctcaacacaataaagtccatataggacaaatgcacagctaatattgcactgaatggggaataggtgaaagcttttcctctgaaatctggaaaaaaatacaaacaagaatgtctacattcatcacttttattcagtatagtgctggaagccctagttagggcaattaggcaagagaaagaaagggcatcaaaattggaaaggaagaagtcaaattgtctctgtctgcatatgacataatcttatatatacaaaaccctaaagactccaccaaaaatattagaataaatttattcagtaaagttgcaagatacaaaatcaacatataaaatcagtagcattaatatacaccaatagcaaactatctgagaaaaaaatgaagaaagcaatatcatttacaatagttaaaaaataaaactaggaacacatttaactaatggattgaaagagctctacaatgaaaactataaaacactgatgaaagaattagaagaggatacaaatggaaagatactctgtgttcaaggattagagaattgatattgtttaaatgtccatactatccaaagcgatctgaagagtcaatgcaatctctatcaaaacactaatggcatcttcacagaaataggagaaaatctaaatatttgtatggaaccacaaaataactcaaatagccaaagtaatcttgagtgaaaagaacaaagctggaggcatcacactatatgacttactacatagctatagtaaccaaatgagcatcatattggcataaaaaataaacatagagaccaacagaagagaaaacacagaaataactccacacacctacagtcaactgatttatacaaaagtgtcagaaacagtcaatgagaaaaggacaatctctacaataaatggtcctgggaaaactggatatctgcatgcagaagaatgaagctacattcctatctctcaccatataaaagaatcaacttaaaatggattcaagattcaaatgtaagacctgaaagtatgaaactactagaagaaaatatgggggaaactattcatgacattggtctaggcaaggatttttttgatatgtccttaaaagcacaggcaaaagaaagcaaaaatagacaaatggaattatatcttactaaagagtcctgcacagcaaaggaaacaatgaatgaagacacaacatacagaatgggagaaaatgcttgcatagtatgcatgtgacaaggggttaataaccagaatatataagaaactcaatagcaaaacaaaaaacaacaaaaaaaaacaaaaacaaacaaactccaatttaaaaataggcctaagacctgacctaacatttctcaaaagaagatatacaagtggccaacaggtatatgaaaaattccttaataagactaatcatcagggaaacgcaaatcaaaaccacagcaagacatcacctcacacttgtcaacatgactattatcaaaaaattaaaataaaaataacattattcagctcccatttataagtgagaacatgcagtgtttggttttctgttcctacattagtttgcttaggataatagcttccaactccatccatgtccctgcaaaggacatgatctcgtttctttttatggctgcatagtattccatggtgtatatgtaccacattttctttatccactctatcatcgatgagtatttgggttgattccacatttttgctattgtgaatagtgatgcaaaaaacacacaaggacatggaggggaacaacacacactggggcctgttggggggtgaagcagaggggggaagagtattaagaaaaatagctaatgcatgctggacttcatacctagatgatgggttggcaggtgcagcaaaccaccgtggcacacgtttacctatgtaacaaaccagcacatcctgcacatgtagcctataacttaaaaaaaaacacccacttcaaacagaaaagaattatttttaacactccttttaaataaaaatttaacacacacacaactaaaaaaataaaaaatattggcatggatgtggagaaatgggaacacttatacattattggtgggaatgtacattagtacagccattttggagaatagtaagaaagttcttcagaaaaatgaaaatagaactgtcatataatccagtaatcccactactgggtactatcccaaagaaatgaaattggtatattgaagagatagctgtactcccatgtttattgaagcactattcgcaatagccaagatttagaaacaacatgccactcaacagatgaatggataaagaaactgttacacatatatacaatggaatactgttagccataaaaaagaataaaatctgtcatttgcagcaaccttcaggaactgggagaacattatgttaagtgaaataagccagggacagaaagacaaatataggatgatatcactcatctgtggaatttttttaaaaaaataaactgatctcatagaaccacagagtagaagaccagatactagagactggggaagggtggagaaaggtggagactgggagagattggtcaatgagtagaaaattacagacaggaggaacaggttctggtgttctattgcatattaggatggctatagtcaacattattgtatgtgtatgtcaaaataactagaagagaaaattttgaatcttctcacaacaaaacattttgatatttaaggtgatgtaaaagctaattaccctaatttttattacacaatgtatacacatatgaaaaaaatcacattgtaccctctaagtatgtacaattatgtgtcatttaaaaataaaacattttaagaaatagatgaaacattttcaaggagatttgtgaaggaaacagtgactttgctacctagtatgcattcagccttcctctccccttctggaaaagatcatgtgatttctttggggaaactaccactttttactatcaggccaggttgttggatggtgttgtcatctagcaatatttgagaaaccgattcctcttgtcaacgttcttgattcatgcatgaccatatgacacaatcaaaaccaatggtaatattttgagtctttatgtgaaaattcactaataaagaatattgcttaggttttttaaccatcattagacacaatgctgtttctgggaaccatcacatgaaacaaaaaaaagcaggagcagcagagccaagtgaaactgtgtcctacattgtggctgctgctgctgcttttgttataggcatcaatgaattcaagtactgtgtcagcctgagttccatttcttttacttttgtcactttatatagaaatgtccctacagcatacaagatgtttacaagtgtcaaatacaaaaagaataataagatatgaagacacagacctatttagcaatgaaattatttgtaaagttgaccagagatttttttgttgttcacatttacgaatgtaaaagacatgaattgcatccagccatcatagattgttctaccaaataagccaggagatggaaaaagtaaagaagtgggttttataaggggttagtaagcattagtatcaaaatgaatgcctagaaatttggattctcaatgtcagaattatagtatttttgtaagaagagtcccatcagatgttaagtctacttgtattcaactataaatcagagaagtatcagtgtaaatgtaaaaattcatgttttgtgctcacaatgatatcttttctaccaccaaaaatgcatgttttaaaacatctttaacatttcagggtcttctattatgttatttacatatatcacttttatattttattccaaatactataatttcagcaaaacagtatagaaaatttgcttgtattacatggtgaaggatgagacgtgtgtaataactcattatgatatacttaatagacctgtccttggtaccagcaaaagtaaaaagcagcattaaatggattttttttttttttttttagatgaagtctcgctttttctcccaggctggggtgcagctcactgcaacctccgcttcccaggttcaagcaaggctcacgcctcagccctccaagtagctgggattacaggcacacgccaccacacctggctaatttttgcatttttagtagagatggggtttcaccatgttggccaggctcgtctggaactcctgacctcaagtgatctgcctgcctcagcctcccaaagtcctgggattacaggcgtgagctgccacacccagccctgagatatcttcaagaattaacaagttatgatggaaagaatagcaaataaattgtaaaaaatgttaaatataaaaccataacaaattttgacatctattttacctgagagtatatcttcaaaatatatgtttcagtcccttgtggttattttaaaaagttaatgtattcaattaaaaatattgtactttacagagataaaattttcaggaatcttgtttctgggtacactaaaccatttcttactttgatacgttaagcacctcacgtattgttttagttattttggataattggaatctagtatttaaactaaaaggctttcaataacacacaggtaacaaaacaagcatccactaaatttatgtattttataacaattcataatgagtcttagggaagtgttataatagaatcacattacacaattcataccaaaaaaggactacagaaaaatgcaacttttatttaaaataagagggatagaaaaactccattttttacatttgcttaaatgaagaaaatttaaaaatgtttatttaattcatttatgtggttagagcaacaaagaatgcaaaacaggaaggaaacagcaggcctactttatacaaacaacacaaggaaactccttatttttgtaaaactctacataagaaaccctatagcaaatgtcatactaaaaagggaattttggatgcagtttctttaagattggctaaaatataaggattcctattaggtttacacatattactagagatcttgttcaatgcaataacagaataaatagatataagggctataagaataggaaaagtagacatatatctgtcattactaagaaaaaattttgccaagcaaactactggtcacttaaagaaattttttcctctctttctgcatttaaatacaaagcattgaagttactatttttgtctgtttctggagagctaaaactgatgtttgtgctcttattagaagcacatttttacatgtctttgattaagcttattaattatgttattcaagttattcatgataattttggtcactgtaaatctttgcttttagggggtagttaagtttctcaactaaaatagatgattatattccttttggaatttctatcacagtgcttttatatgtttataaaattgagttgctatgtatagctatgttcattgtcattgataagaatttaaaaattatactgtcctttatctagaaactatcttaacaaaaaaggcaagacaactgttataaacctgttcataacctaccaaggaaaataaaactagatatgtttgttgaatttagtaaatctgcatgtttaaaattcttcacatattaaaatgttctaccatccttatttttctgttacttaactaattagtacccatgctactatttctttttcccctacaattataatgtatctatatattttgatttatcccaattaacatctaattaacccattcatcatcaatttataatgtgaggaaatttttcattgtaatttctgcaaatattttttctaactcatttattttcctcactattttggaatctacataagttagagaagtctatgatttaactgtaccttctcattttgaagaaaagactgacaaatttataaaaaaaaaaaaaaccctcatcttaccagtaactagttctccagaaattattatttggttattcaactcacctaagttttttattttcactattatttctgtaaaggtattttcaaattattcatttttgtaatgatgtgcttctttccaattaaagttataatcatacttctttatatctttgagagtatttataagttgttttacattcttgttttatttggtccactaaacatgtttgtatagtataagatgctccttttgttgtctttgtaaggttatatcttttttttctctgtttactactaatattcatatagttgtgtgtgtgtgtgtgtatatgggagatggagtctcactctgtcacccaggctggagtgcagtggtgcaatctcagctcactgcaacctcagcctcccgggttcaagcaattctcctgcctcagcctctcaagtagctgggactacaggcacgtgccgccatgcctagcttattttttgtattttagtagagacagggttccaccgtgttgcccaggctggtctcaaactcccgagctcaggcaatccacctacctcgacctcccaaagtgctaggattacaggtgtgagccactgcaccttgcctgtatcggtatcttgtttgaaaatctatattaaataataagcactaaagctttccctaagcttgtgccccctctggtgagtttatggagtaaatccgaacatatgtctcaagatggaatcctctagaggtatagtctgggctcaatcagtccccatccatcacttttcatcagcagatgcagtttttagagaatttacaaatgagccttcttctggagggccatgttttgcattgatatgggtaagaagagggatgccagggatatggctagcatgctttctcctattattcattcctgctgcaaccagactcaggagccactttgactctgaccagtagtagactaattcttctgtttctttgtcaagtggacttttaacagaatggggaaaattctaaaccaactgtataaagcattgaatttcaatccaaaacatatttagaatatactcaaattttataaaagaagccaacttcaaacgattttttttaatcaggtaaagtaatcctgaaattcactctgatttacttcctgcactctaaaggaaaaagggtgctagaaaaaatatttacctttacatatataaatgaacagcttagcattaaggatacagcctaatactcaatcccacaactatcacagctaggaaagtcattaagaggaagctggtggttgaaaccctgccaacctgcatctatcattctcagtttttgctttatattagtggtaaatttagttcccaatatatagattatctaactctgactaaatttgtccaacttcttgacctttcatgaactgacaacccactgtcacacttaagtcacttgataattgtgactttgctgatctctggcaaggcctaagactcatgacttgaaagccctacagccaataaaacttaataacttgccattaggtttctagttaagtcagacaaatatgtacttaaaaattgaaatagtttattagattatgttattttatccttttcagtgtatatctttacttttagataactaatatatacaaaagggaacaggactgttgaaaaactgagtatttttagtaagctattaaaattaagtatatacaagcgatattatcttcactgtgaagctagtaacttaattatatcaacgtaagaaaatgtcacagcataaaaggttttattcacaaagaattcattcaaagacatagactatgtgatagtctatacactgctataaaacattgatttaatttgcctaatagtcaatattaaatctacatgtgtaattaataatttaccattaccaaaataatcttagtacaggctgcctcattttactgtgtttcactcttttgcacattgcagatactgtgcttttttcaaatagaaggtttgtggcaaccctgtgtcaagcaagtctatcgacaccatttctccaacagtgtgtgctcacattatgtctgtgtcacattttgcaaattctcacaatgtttcaagcttttccactattaatatatatggtatggtgatctgtgatcagtgatatttgattttactattgtaattgttttggggcaccacaaaccacacttttataagacagtaaaacttaattgataaatgctgtgtgtgttctgaccagctgattcccatctctctccctctcttcaggcctccccattacataagacacaacactgttgaaattaaaccaattaataactctacaatggcctcaaagttttcaaatgaaatgaagagtcacatatctttctcttcaaatcgaaagctagaaatgattatgctttgtgaagaaggaatgttgaaagccaaactaggtgaaaagctaggcctctcacacaaaacatttagccaagatgtgaatgcaaaggaaaacttcatgaaggaaattaaaagtgctactccagtgaagacacaaatgttgagaatacaaaacagacttattactattatggaaaaagtttgagtggtctggatagaagatcagatcagccacatttccttaagccaaagcctaatccagaggaaggctctaactctctccaattctatgaaggctgattgatgaggaagctgcagaataaaagggggacttagcagaagttggttcataagtttaaaggaatgtagccatctccataaaagtgcaaggtgaagcagcaagtgttgatgaagaagctgcagcaagttatccagaagatctagctaagatcactgataatggtggctacactaaacatcaaattttcaacacagatcaaacagccttctattggaagacacaactaaagacattcatagctaggaaaaaagtcaacacctgcttcaagtcttcaaaaagacatgttgactcttgttagaattgtagctgatgacttaagttgaagctgaagcttacttaccattctaaaaatccttagaaattatgttacatctactctccctgtgctctataaatggaacaacaaagcctgggtgacagcacttgtgtttatgacatgatttactgaacattttaatccagaaaaaaaggttcctttcaaaatattactgttcattgacaatgtactagtcacacaagagctctgatattaatattacaggatattaatattttcatgactgcgaacacaacatccactctacagctcatggatcaagaaatcattgtgacgttcaagtctcatttaagaaatgatttttgagaggctagagctgccacaaatagtgatttctatgatggatcttggcaaagaaaatgtaaaaccttctggaaagaattcaccattctagaagccactgaaaacattcatgattcataggaggaggtcataatatcaacattaagaaagatttagaagaagttgattccagcccttataaattagtttgaggggttcaagacttcagtggaggaagtcactgcaaatgtagtgaaaatagcaagagaactagaattagaaatgaagcctgaggatgtaactgaattgctgcaatctcatgataaaacctgatggatgaggatttacttctcatggattagcaaggaaagtggtttcctgagatgaaatctactcctgatgaagttgctataaacactgttgaaattataacaaaggatttagaatattaaataaccttagttaataaagcagtggcagtgtttgagattgattccaattttgaaagcaattctattgtgagtaaaatgctataaaatagctccacatgctacagagaaatctttcctgaaaggaagagtcaattgatgtgcctaacttcattgttgtcttattttaagaaattgccacagtcaccctaactttcagcaaccaatatcctgataagtcagcagccatacatatcgaagtaacatcctccaccagcaaaaacactatgacttcctgaagtgtcagataaccgtttgcattttttagcaatattttaaattaaggcatgcacattgttacacacaatgctattacacacttagactacagtatagtgtaagtataaattttatatgaactgggaaacaaaaaaaaattttgtgtgactcactattgtaatatttgctttattgtggtggtttgaagctgaatctgcaatatctccaaagcatgccatattttacctctaaaaaataatttgcgtcatacttaaaggacaatgaggaaaagagaaaaatcccaacagttacacattcccaaagtacatattttcttctgtatacatcatttttcaagttgaatggtatattattaattccttaacaaaatatataaagaattttagcaattatttttaaaaattggtactttcatattggttgcaaaaagttgtattagctccttcaaatatatacatcaatttgttgctcagggaggaaaaaaaatccctgaaaactgtataaaattagtatgcacatatttgtaaacaagtatagcatcataacacagttcttttcttatcagtttttcctcttcaaacgttgtgttcttaaagcaagtcatacatcaggccaggcgtggtggctcatacctgtaatcccagcactttgggaggctgaggtgggtggattacaaggtcaagagatcgagaccatcctggccaacattgtgaaaccccgtctctactaaaaatacaaaaattagccaggcgtggtagcaggcgcctgtaatcccagctacttgggaggctgaggcaggagaaccacttgaacctgggaggcggaggttgcagtgagccgagatcacgctactgcactccagcctggtgacagagcgagactccatctcaaaaaacaaaacaaaacagaacaaaaaaaacacgtcatacacctatgacactgtatttcaatcttagttgttacaggattaactatcttatcataatggactactcttgtagtaataaaatcctcttgaaaattacgcattgttgattcataaatgtatagcccaaagacttgtcccaaaatgcagatttgtctgtcatctagggccacttagaactgcttttttaaaaaatttttggtccagcatcatatgaagattttaggagtgcactaggaaacaatagcctggtttctacttttttaattgatgtcagaacttccgatcaaatcaggaagaaattgaatctttcctcaacatgtttgagttcctcctctttattaacttagtgatcacaattgaggagtatatttattattactagtccacatttatctcctcctttaatcagttattacttttggcatgattatttttgatacaattcttttcttgatgtcagagtaatatctactgatttcaactctcatttttatgttttgtcacatattctattattttttgatatgaactttcactctatgtgtgtcccaatcaaaagtctataatcttcgctttattttagtaaagccttataaggcatctttcaaaattatagtcaaaatggcatgtttaagcttagataaatgcatagtgtgtttcaaattgtacacactgtaccatttctgacaggagggagcatctattttaactatgccctaatgagcactaaaccttctgatttcaattttatacatctgatgatggcatgaatttttttgagactggcttctggcttgatacttttcaaactttggcataccatgcccttgtgtcagtagcttgatgagtgggcaaagtggagaataaggagtattcccaggcattcctctgggaaggtaagcaccattgtaaccacacttggaaggatggcaaaacacatcactatcccccataatctccaaatcaatgtattcccaactcaactttctctttactaaacattgaaaatgcctgcagtcactgcaatgcccccgacacaaaggaaagtatgatagagaagtcaaaatgaaaagagacaatgtcttaactaatgatggtttaaaaatcttggttttgaaaattttacaaaaacagatttctaggactcctgtagggctttagaaggggctctgcaattgtaggaccaggaagcttaaacttcattagcttcccagtaaagatgcctcagctataaagataaaacacaattttgtatatgttttacttagggtttctcttggtcattgatgaaagtttctttctgggacataaacttttcacgttacctaagttcattttgaggtctgaatattttttagaatactttacttgttatctcctctttctggtttttcctcttgcaatctcacttatccatgttcatcttgaaggcacatctctctggccagatctataactcataaaggtacctcacgaagcttcttaggcaattttatttattttattattatttcagtagtttgcgggaagaggtggtatttggttacatggataaattatttagtggtgatttctgagcttgtggtgcacccatcaccagagcagtgtacactgcacccaacgtgtactcttttgtccctcacccatccccactcttcctcccaagtcccagaagtccattatatcattcttatgcctttgcatcctcatagcttaactcccacttacaagtgggaacatacgatgtttggtttttcattcctgagtacttcacttagaataatggcctctaactccatccaagttgttacaaatgccatcatttcattcctttttatggttgagtagtattccatggtgtatatataccacattttctttatctactcattgtttatttagtctggtttcttaaagtatttattaacaattttaccaagtctcttggtccaaacaaaacaagagcattaggaccctaagttatgactaactggcctattaatttggtacagttaatcttgatccctgcttctcccaatcctctacaccattcacccccaccatgatttatcacctaggtaggataggtaattctaccaaggctccagccttgctcaaataatccatggagaatactgtttataagaagcctacttgtaaggcccagaatgcctgttttgaaaattcttcagtcatttaaaccagtttatactatatatttattgccatgagctctgtgccagccacatggcaatattgtgagatattctcgtaagagaaaaagaaaactggaagaatgtatttattaactaaaatgttaactaggaacatttcctaagaagtcatatgatggccatagttttatctgtgtaatatatctattataaagacaaatgagaacagtatatggtaatcattaaatgtgaaggctctggacagagactgccaagtggaaagtcctggtctacaatttataaatggtatacaccctcaggaaagtcaattgccagtctgtgactcagtttctttgtctgagaaaaggacacagactgtagtgagtattaataaactaatatataggaacatttagaatgatcccaggctggtagcaaataatctaattatgattaattaattaatgactcacactatgatactttgtatgtttaaaagtgatcctgagggtatatatattgtgtggtacatacataatatatattgatgtattaataggtcatttaaaggtcacatggataaatcaataaatttgtatattaaaacgtatatatacaaaataatcatatcctgagacagtacatttttaaattacttgcgtagtcgttttaaaaatccaccagaggaactcttttatgcatttcttcacccagagtgaaaaaggagatgtaacttttcaaattctatttttcttgcttcatttttagctgaccaatcattaaaaaattatcaaactggaaaaaaagcatttaaactgaaaatctcaatcaaaacataataagcagaactataatccagtatcaacatattttcctctgcctaaagctaaaataccttttcttattaagaaccatacaagaatcccattccccttgcaaaggaggcacatttatctgagggtaaattgtgcaatattaccatcataatttcaaaggaaagaatgaaaagcaaacacaactctcaaaatgctcgggctagtgttcactaaattctgttgtcgtagttgttaaaatgatttcagggataaaaagaaaactgaaaactaaaccttttatataagatgccaataaagttgctacatcatctgagttactcaaatccaggttttatttcataaattttaacctagcaaatactaaatctttaatcttagcaaggttacatagtataactgtaggtcaactagagcagacaccaagagacctggagtgggggacctcgttccacaatggttgaacatacttgagaaaatcaattcaagtctcagtacttactgtcaaactgtcagaggagttttaaagatatatgagcataattctatactagatgagagattagggccacataaacctatggatgctcagataaacatcaaagaattgtgacattgaccaaatcaaatttaacaacacaaaccagattttaaattttaatacttagggaagacaaaaaaaatttcattaaaatggtaaccaccagaaataatctgaactaagaatcacaatgctacaataacatttgagaaaacacattaatatgacatactactaaattatttgaaaatatatcacaacagaatatgaaatacaaatgtaatattattttaaaggcactctaatagatttaaacaaaagaaaagcaacttcagcaaattcagatggttactttttcctgaaatatatataaatattaatgtgcaaattttaaaaatatatttccatcttataattgaagccacatctgagtaaagaaccctgattaaagtttcaggaatacacatttgtgaacaataacaacaaaacaatggtaacaagaacttcttagcaaattactatattaatgaagcaaagaacaaaaccccaaatgcaactattgagagcccaattgtcataagcatactatttcttaaaattattgatctctgaactatttttcaataactcacaaggtcaataaatgcagcatgtagggaccatttcagagtgtgggacaaaaccattcccgtgcatacacatgattagactaagtttccaatttatttggccttagataacgaacatcagcagaaggtgggtagctacgcagggcaggttagtaattgagcgaggactggcttccttgcattcaaggtttcttgtgaaggaacactacctatgggagggccagcattccatctgagaagttacactcattgcttcctttttagactcagggcttatatcatagttttaaagtttataccaacagtgcactttctgaaatgtcagggtatatgtactaatatttgtttctattagtgtttaaaatcaactcacaaaagccacatcattgagagaaaactgaaccagtgctgaggaagcctcaataaatagctgtctctgtataaagactattttctcaagaaatagccctcataattaatactccacagaatgtgctttgaggtctgccactctaaatattttgaactttagccttggagaataacattggtggtgctgcacacgtaaaacactctgggctccctacggatttgatgtcactgtatttatgaacttgcagtcagaaacagccatatgctatatactactgaaattattacagagctgttcttgagtggtattaccaaacacatagtacaccttagtatcagtacctacaaaaactatggcctgtatgagaaattcattttaatcttttggatactgtaaacctgtggagtatacacatttagttcttttctttggctgctaggaagctcaaagcccaatctgtagctcacagctagataacgtgttgactcttatgctgcttaccttcagatttacccatttccctgcctttatcttccctttgcgccaattatatatttaatatgttgcctcaagttatttcaaaaataatgaagagacaatgtgagtagagaggcaaatatactgttttatatattcacataaattatgcatatttattttatatatatttatataaaatataatgggcatttattttacatatgcttatgtacagaactgagtttttagcccaaaaaaataaaagtgataaagctattactaacctaataggattaaaggcatataatgtaaatgtgcacctttatttaaagaaattaagtagcaacaaaaaagtatgccggatcttgtttctgaagaccttgatttgaaatttttcattttaatacctagatgaccttagctgattaaatttaataatatttataaaaatgttttgaattgtaaaactccttaagtaatcaaggttttaagatgcaatataaatcaatcaaacaaaaaagttagtatgagtaacactagtgggaagtgagtttttaggaagattcttcctttccaagaaaggcttgagggagtgagacacttgattttgaggaggcctccatgtaaggtcagctgatagaatttactagaaattatataagggtcttccacagcccttctcactgaaaaaaaaaatccttgtaagagaatacacctggcctgtctgattatccctaagacagtaaattatggatttacgagccacagttgtgttagagaatggatgttaatcaggtagtctttcttgcaaggtctaaaagagagagagatcctgaaaggaaatggatcatctgggcctgtacagaccacacagaattactactcatcagtcactgaaacaaactgtgtgtcagtgcaggaattggcaccatagaaagcttcatctgctggtttgggacttcccagctgctgggttggtaatatccctaatatccccctctaatcattagtaaaccttggtgcatgaggcattgtactagtccattttcatgctgctataaagacatacccgagactgggtaatttataaaggaaagatgtttaattgactcacagttctgcgtggctgtggaggcctcaggaaacttggaatcatggtggaagggggtgcaaacacgtccttcttcaccaggcagcaagagagacaagtgcagagtgaaggaggaaaagccccttataaaaccatcagatctcgtgagaactaactcactaacaagagaacagcaagagggaactgcccccatgatcactatcaccttccacgaggtctctcccccaagaagtggggaattacaattcaaattacaattcaagatgagatctgggtgaggatacagagccaggccatatgaggtatctatctctacccatttatctgcctatcaatttatcgatagatttatctgtccacccaaatatacacccatccaccaacccaaacaactatggaaaggaaataatatttagaaaaagcttaagtgacaataaaacaaagaaaatgtcaacaacatttgtcattgtaaataaaatagacagaaaatatgatgcagccagataaacgtgatttcaaatcaagctgtgaaaacttaggcaatttatgtaacctttctgagcttcagtttgaatgcctattaagtccgaaagtaataaaacatccatagtattgctataaaattacctgacatgtagatgaagcaaacagcacaatgttcaaaaatcaataaatggaaatataacccgactttagcaaaaagaaaataaatataacagattcccttaaaccttcataatatttgaacaaaagtaaaagcaaatataatacatgtaacaaagtttggctttagtctgagtatcagcataaaatttgttatatttttgccctgggcttttggagatagaatacttactacaaagtcattctggaattcccaaaatatgagtaatcaatgacaatattatcaaataggttaatatcatctctattcaggtcaaaaatgtagctaatatgtaaaaagcatgacatcaaatgtagagttgacatccatatatacacattcaaatacaatacacattgtagatgaaacttagtaatgtctcctcatgtcagctcaaatatgaatatgaataatgtaaatattattgtaaaatatgttgaaataattcatgatagttgtgaagctgttgatttaatatacaaaaataattcttaataattttaaatagttaaacaaatagggaaatcagttgtgagtttctatatatgtaaagagattgtactggtgtacctaggtaactttaggtagaaagaaaatatttataaaaatgtcaccaataaaaggaaaagaaaagaaattagataataacataactagttttgtagacttgttttatgtgctaaaattcataacattaaaatacactttaaaaaaatttattgtctagttattttactgcatttaagccatattcctcaagaaaacattttatttgtgaattcttcatatctcttaaagaaaaattaaaagcagaatgccaaattcaccacctcaaaccaaaagagaaatatctcaaaaatcacgcaaaatgtcatgaaaaatcatctttgatgtagatacaataaaggatacaaggaatatgaagaggtgtatgttacagataaatagggtaatctcaaaatatgttccacctccactggtctgggttgaaagtaaagtatctatttggtattataaatgttagttatactgactgtagaagcaatatcagagttgacagtcttgagaaatacaaagtcaaacttatagaaatttaacttctgaaatgtttaaatgtttaaacatttaaatataaatataatgttcaatattgttattaatgttaaatatgtttaatatgtttagtgtttaaatataattatatactttattttagatacatacaaaacaagtatattctaagatagagatacgtgactttaaattttatttctatgaaatattgatttcaacgctcaacatttaataaaatgtatattaggtacatctctaagtgggaattcaatgatgacttcattagatggaaacctcattctgctaagaggggagcatttgatgatgtcttagctattttgttaaaaataagagaaataagagcaaaaatgtctactttcaagttaattctgattcaaaacagaaacaagagctaatggacagcatgaaacctataggaagcttggaaactgtgttaaggagaaaaaattaaatgccagaagcagacatacataataaagactaggaaaacacattcaagagaaagtcaggataggctgaaaggtataaatgggcaaatatcatgaatatggactctgaaagatttattatatatattttgtatactatatatatttttaatattgtctcattttttaatttttgtgggtacataacaggtgtatatatttatggggcacataagatgttttgatacaggcacgcaatttgacataagcacattatggagaatggggtatccatctgttaaagcatttatccttcgagttacaaataatccaattacactctttctttttaaatatacaactaagttattattgactatagtcaacttgtgttgtatcaatttacactcctaacaacagggtacaagagttttcttttcttttctccattttctcgccaacatttactattgcctgtcttttggatataagtcattttaattggagtgagatgatacctaattgtagttttgattttcatttctctgatggtcagtgatgttgagcacctttttatatacctgtttgccatttgtatatattcttttgagaaatgtctattcaaatcttttgctcattctttgattggattattatatatttttttcctatagaactgtttgagctcattacacattctgcttattaatctcttgtcagataggtagtttgcaaatattttctcccattctgtgagttgatgcttcattttgttgattgtatcatttgctgtgcagaagctttttaacttgatgtgatcccatttgtccatttctgcttttgttgcctgtgcttgtggggtattgctcaaaaatttttgcccagaccaatatcctggagatcttcccccaatattttcttgtatgaatttcacagtttgaggtcttagatttaagtttttaatccattttaatttggattttttataagatgagaaataggggtcttatttcattgttctgcaacatgaatatccagttttcccatcactgtacattgaagagactgtctttccctccagtgtatgttcttcacacctttgtcaaaactgcattaacagtaggtgcatggatttgtttctgggttctctattccacttcattggtctatgtgtctgtttttatgctagaaccatgcttctttcccatatctctggagtatcatttgaagtcaggtaacgtgactcctccggttttcttatttttgcttaagacagctttggctattctgggtcttttgtcattccatataaatttcaggattgttttttctattttctatgaagaatataattggtattttgaaagggattgcatttaatctgtagattgccttgggtagtatggacattttaacaatattgattcttccaatccataaacacaaaatatttttccatttttgggtgtcctctccaatttctttcttcagtgttttatagtttccttatagagatctttcacctagtatttaattatatgtgtggctactataattgggattaatttttaaaattcattttcacattgttcactgttggcatatagaaatgctattgaattttgtatgttaatttggtatcctgcatctttactgaattggtataccagttctcaaaattttcctgtagagtctttagatttttctaaatataagatcatatcatctacaaacaaggataatgtgacttcttcctttccaatttggatgcaatttatgtctttctcttgtccaattgctctagctaggacttccaatattatgttgaataaagttcatatggaaccaaaaaacagcccgcattgccaactcaatcctaagccaaaagaacaaagctggaggtatcatgctacctgacttcaatctatattacaaggctatagtaaccaaaacagcatggtactggtaccaaaacagagatacagaccaatggaacagaacagagccctcagaaataatgccgcatatctacaactatctgatctctgacaaacctgacaaaaacaagaaacagggaaaggattccctatttaataaatggtgctgggaaaactggctagccatatggaaagctgaaactggatcccttccttacaccttatacaaaaattaattcaagatggattaaagacttaaatgttagacctaaaaccataaaaaccctagaagaaaacctaagcaataccattcaggacataggcatgggcaaggacttcatgtctaaaacaccaaaagcaatggcaacaaaagcctaaattgacaaatgggatctaattaaactaaagagcttctgcacagcaaaagaaactaccatcagagtgaacaggcaacctacagaatgggagaaaatttttgcaatctactcatctgacaaagggctaatatccagaatccacaaagaactcaaacaaatttacaagaaaaaaacaaacaaccccatcaacaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaacgggaacacttttacactgttggtgggactgtaaactagttcaaccattgtggaagtcagtgtagcgattcctcagggatctagaactagaaataccatttgacccagcaatcccattactgggtatatacccaaaggattatatatcatgctgctataaagacacatgcacacgtatgtttattgaggcactattcacaatagcaaatacttggaaccaacccaaatgtccatcagtgatagactggattaagaaaatgtggtacatatacaccatggaatactatgcagctataaaaaatgatgagttcatgtcctttgtagggacatggatgaagctggaaaccatgattctcaggaaactattgcaaggacaaaaaaccaaacaccgcatgttctcactcatgggtgggaattgaacaatgagaacacatggacacaggaaggggaacatcacacaccggggcctgctagagggtggggggaggggggagggatagcattaggagatatacctaatgtaaatgacgagttaatgggtgcagcacaccaacatggcatatgtatacatatgtaacaatcctgcacgttgtgcacatgtacgctaaaacttaaagtataataaaaaaagaaaaaagaaagtagaggaaaaaaaaaacagtggtgatagtgggtatccttgctgttttccagatcttagagaaaaggcttttggtttttccccattcactatgatattacctgtgggcctatctgtcatatatggcttttatcatgttgaggtatatttcttctgtccccagatttttaagggtttttttttttatcatgatgggatgttgaattttatgaaaacctttttcagcatcaagtgaaatgatcatatggtttttatccttcattctgtatatatgatgtatcacattgattgatttttattcattgaaccatcctttcattccagggataaatcccacttggtcatgatgaatgatctttatatcaataacacattgttgaattttgtttgctagtattttgttgattttgcaacaatattcatcagagatattggcctgtagttttttttatgtttttttaaaaatgtgtctgtctgattttggtatcagggtaatgctggcctcatagaatgtttggaagtattcccccttctctatttttttggaatattttaagtagaattggtattaactcttctttaactgttagatagaattcagcagtaaagtcatcaggtcccaggcttttctttgctgggagactttttattacagcttcagtttcattagctgttattaacctgttccagttttttatttcttcctggttcaatattggtaggttgtatctaggaatttgaccatttcttctagattttccaatttattagcatatagttgctcatagtaggcactaatgatggtttgaatttctgcagtatcagttctaatgtcagctttttcatttctgattttatttgaacctttgtttttcttaataagtctggctaaagagatgtcaattttgtttaactttaaaaaaaacaactttttgtttcattggtcttttatattttttgttcaaatttatttctgctctgatcttatttcttttcttctaccaattttgggtttggtttgctcttgcttttctagttatttaagatacatctttaaattgttcatttgaagtcttccttcttttttgacgtaagaaattgtagctgtaaacctccaagttagtattacctttactgtgtcacataggttttggtatgttgtgcttccattattatttgtttcaagacatttttcaatttctttcttcattgacccacttgtcattcgggagcatattgcttaatttccataggtttgaatagtttccacacgttctattgttatttatttatagttttatttcattgtgatcagggaagatgattcatatcatttcaagtttttgaatgttttaagacttgttttgtgacctaacatatggtctacccttgagaatgatccatgtgctgatccatgggatgagaagaatgtgtattcttcttggatgaactgttctgtaaatatctattagatccacttggcctatagtgcagattaattctgatgtttctttgttattttctgtctggaagatctgttcaatgctgaaagtggggtgttgaagcctccagccattattatttggggcctatctctctcttcagttctaataatgtttcctttatgtatcttggtgctctagtgttgagtacatatatatttaaaattctcatatcctcttgctgaattgactactctatcattatatagtgacgtcatttgtctcttcttacagttttggtgttaaaacctattttgtctgatgtaagtgtagcaactcctgctcttttgtgctttccattggcatgggataatatttttccatccctttaatttcagtctgtgtgtgtctttataggtgaagtatgttccttgaaggaaacagatcaatggatcttgttttttcattcattcagctagtctgtcttttggttggaaagtttagtccatttatattcaatgttattattcataagcaaagacatactcctgccattttattatttgttttctgattgttttgtggtcttctcttccttctttctttccttactgtttttctctagggagggtaattttctctgatatgacttagatttgtgtgtgtgggtgtgtgtgtgtttctcttgtatgtttttggtttttggttttaggataccataaggcttgcaaatactatgttataactcattattttaacctaataacaacgtaacacaatttgcatgaagaaataagcaaaaataaataaaaacttcattcccctgctttttattttctctattgatatctttttgtactcactatgtcttgaaaagttgttgtagttactatttttgtttggttcatcaggtagtctttctacttaggataagagtagcttaaacaccacagttttagtgttataatattctgattttttcctgtgtacttaaaattaccagtgagttttttccttcaggtgattatttatttttcattagtgtccttgtctttctgattgaagtactccatttagcattttttgtaagacaggtctggttttgatgaaattcctcagctttttttttcaggaaaagtctttatttatctttcatatttgaaggaattttttccagatatacaattctaaagtttggttttttttccttcagcatttcaaatatgtcatgccactgtctcctggcctgcaaggcttctgctggcaaatccattgccagatgtattggagctccattgtatgttatttgtttattttcttttgctgcttttaggatcctttctttatccttgacctctgggaatttgattaataaatgccttgaggtagtctttcctttgggtaaatgtgcttgctgtttgttctataactttcttgtgcttggatactgacatatttcactaggtttgggatattctctattattatacctttttataaactgtctacccctatctctttctttatttcctctttaaggccaataactcagatttgctcttttgagtctattttctagattcaatagccatgcttcgttgtctgttattcttctttgtctcctttgactgtgtattttcaaatagcctgtcttcaagctcactaattcttccttctgcttgatcaattttgaaagcaatctgatgcatgcttcaatatgcgtttttgaactagagcgtttctgcttaatttaataattatttcaatcattttgttaaacttatctgatggaattctgaattccttttctgtgttaccttgaatttctttgagttttcttaacacagctattgtgaattctccgtctgaaaggccacttacctatgtgtctccaggattgttccctggtgatttgttcatttggtgaggtcatgttttcctggatggtgttgatgctagtaagtattccttggtgtctaaagagttattatttattgtagtctcactgtttatgcctattcttactcactatttatgcctattcatactcatactcatgttacacctattcatgttcattttttatttataagccctatgactcgtgtaagagctgcagtccttatggcctaaactgcctttcaggtttaaacaccacaattttagtgttataatattctgtgttttcctgtgtacttacaattaccagtgagttttgtaccttcaggtgattgcttattgttcattaatgtccttttctttctgattgaagtactccctttagcatttttagtaaacacagagcactgtagccctcagttgtgaggtttgcaggaactcaagttcccactgctggtatcaacaattcctctccggctaggactggtttaaatgctacctctgtgtgtgggcatcagctgaatttggtccagttttcctttttgctctaacatgacagcactgagttcaatgcgtcaaaattgctgtgttttcccacctcctttcatatgttttatatataactttcttaagactccaaagcatgcaaaatgctgagttaattttaaatgatgtatttatgaaagatccatagagggaaaaaagtaagagacatctatagaaaacaatgtaggtattcttagaatttttcttagctaaaattataaaggccatccaaaaggatgaggggaaaatgacctaagataaatgcaaataagaatagagtacatacattataaaaatagggactgaaaaatttaaagcacacaaagtgattgggcaactcagagaaacccaaaaaaggaagagtaaattatatgtcagggaagaaaatgcacaagtaagtactagatcaaatttccgagaaagacagttaaattatatgtaatgtcagagataatgaggtatcttcaatacttattcaatttattacctattgtcatccaagtagagcaatcataaaattcaagaacctagaatgaacaaaattaagtgggaatagatacccaagttattagagcactcaccctctctttaaataagtatggagatttaggtcttcattaattacatttcaggacacaaaagaactatcaaacgtcactgtagggtaatcattaataaatcatgaagcttttatatcaattccagagataaaaaatgttttataacttttaatgtagaaaatgatatggtaggagaattgagtccaacatgcagcaatacatgaaacaaatgttttgagtgaattaagaaaagggaacaattgattgactaagaaaaaatcaaggaaaattggtctcacttcttcatattaatagagacaaatgaattaaaggaaatctacaatacctttttctgttgctttgaaaaggggttatttttattataagtatatttacaaggattttcataacaatttaagaacatttatgcattgaatgatttttaatgtattggttagacacagcaaaaagtacaagtcaatggtgaaaagtacatgctctcaaattggacttcccaaatttgtttcctgtttcatgcttggctgtgtgatcttacacaagttattcaacctctcttagctacacaggattatgtaaaatgacccatagccagaagtctttgctcaaaaattatctttaattattattttaatcttcatttaatgtatacaaatacactataaaatacatcatattttcattttacaaggaaagaaaattaggcctagagaagttacaaactatatcctaggctatttaggaataggtgattccactttaggtctcttcctatgatctgacagtatattatttcttcaatagtttgccaatttgaaattcgtttttaagtttaattattctaattttagtactattaaagtctatatgtatggcatatatatgtatatatatgtgtgtatatatgtatatatgtgtttatatatgtgtgtgtgtgtttatatgtatatgtatccatcttttcattccactacataatatcctgtatttttcctaaaattagggttgaaaaataatacattttactcaatgctaaccaaatataactgaaattttacactggcttagattcttaaaaccatttatacatcatatttaaacattttatgtttaccccagtagtgacaataaacattatttttgtctttgccatttttctgcattgttgagtgaaatactactgatgaatgtataaactactcttgtgaaaaaaatgaagcctttctatgtggctttcattaaaaatgtagagcattgcttatgaggaacatttgatataaagtcatgggtatccctgagaatctcttctctgctcccatcccatgcttcaacagtttccacagtaatagctttatacatgcattgaaatcttgggagaatgctgaattctagaaattcagttatcctcctggccttttaaataaacttagagttatctcagagaaaattcacctaaataacttgactctcaacaaaatgtacatgtggcatatttgctgctaaaaaactctgcagaaatataaactgagaatctcaattttgataagtctttggtgattgtgagacatcatatacacactcagatccccagatcacacatggcaaacaaagcttcaaaaaatgcttttctacagggaacaagtataggttctggaatgaggcctgtgtttggaagacattttattcaccagtttcatgtttgaatttgctcagtcacatgcattgaaggtatttatttgtaaaatggggatgagggatgcttctcgtttcagtgtgattttgagtaaatcaaatagaaaagatacctggaataaaacaggaaggtgcccagcacttccttttcctttctctctctagtcagttacctaagagcctctcttctttgacaagatttcaaataatgtataagaaaatcagactaaaactatttccaaaaaggcaaaagttgaaatatcagaaaaaactcattatgatattagtaatcacaactaataattacttgaatggtgctatgagataggcattgtgccaagtacttttcatccattacctcatttcaaatacattaaattacctcatttcaaatacattaaattatcgttagtttttatgtcaacgtgattgagccaaggggtgctcagacatacggccaaagattgttctagatgtgtctgtgagagtgcttccagatgagattaacatttgaatcagtaggccgactaaagcaaattggccttcctgacatgggtgggtctcatgcaatcagttgaagaactaaatagcctaaaggctaagagggaacttctcctacctgacggcaagtgctgagacactgttcagtttttattcccagctttaggacttggactgaagtaagctcctcttgtgtcttaagcctgccagctctaggactaaaatttataccattggctttgctggttcttcagctcctcagctgtaggtcttgggcttctcagcctccataatcaaatgagccaatttcttataataagtatcttgccacccccacccagtacaagcatgcccctctgcccatctgcccatctatccatccatccatccatctatctatacatatgccctgttggctccatttatttggatatgcctgactaatacagttagctgttattacaccctcaagttgtagatattatagtcttaaagagatgatggatcatataataaaaaatacacatgatggtgttcaagaagttcatggaaaatacatattatgaaatatctatgcgtgaagatcaaaaatttttgcaccaaaataaacttgtgttaacttgttattacatgtctgacatgatctagtttgaggcactaaaaaggataagacatcagttagaaaagagctcctaaaagggcagcattaattctgctaaaattaaagctagaacaaacatcaaatttattgtgaagcttgggtgaaaaaaatggtgaaatcattgacgctttagattaagtttatggggacaatgccccaaagaaatcagcagtttaaaaattgataacccattttaagaagggaaaatatgatgttgaagatgtagcttgcagcagcagatgattcacatcaatttgcaaaaacaaaattaatcttgttcatgccctcattgaggagaaccaatgattaatatagcagaaacgataagtgaatgacatagacatctcaattggttcaacttacacagtgttgactgaaaaattaaagttaagtaaacttcccactcaattggtatcaaaagtattttgcctaaatcagctctagacacaagcagggatttaaaaagaaattttatacttgagaggctgagagtaggagaatcacttgaaaccgggaggtggaggttgcagcgagctgagatggcgctactgcactccagcttggtgccatagtgagactccatcttggggaaaaaaaaaaagaaattttagacaagtaggatcaagatctggaagcattttttcaaagaattgtaacaagagataaaacatggctttactagcacaatcattaagaaaatgcatgatcaaagcaattgctaccctgaggtgaaagtggtccaagacaaagcaaaagtgggccaatcaagagcaatggtcatggcaacagttttcttgggatactcaaggcattttacttgttgactttctagagggccaaagaaccataacatttgcttactatgagagggttttgagaaagtttgccaaagatttagcagaaaaatgctctaaaaaccttcaccacagagtccttctctaccatgatgatagtcctacttattcctctaattacataaggaaaatgtttggggagttttgatgggacatcgttaggtatccaccttaccatcatgatttagcttcttctgacttagttttatttcctaatcttaagaaacatttaagggcagccattgtcttcagttaataatgtaaaacgacagcattgacatagttaaatccccaggaccctcagttctttaggaatggagtacattgccatatatgcatatcatatatatgtatgaggaaatttattgagggaattggctcatatgattatggaggctgtgaaatcccacaatatgccatctgtaagctaaagaatcaggaaaacaagcggcataattcagttcacatctgaaggcttgagaaacaggtgtgggctaatgagggactgatgatatataagtcctagagtctgaagggccaaaataaaggagctctgatgcctgagggcaagagaatttggatctcccagctcaagaagagaaagagtatttgcccttcctctgcctttttgttctattcaggtgctcaagagattggatgatgtcttcccacattggtgaagatggatcttttttactcagtctactgattcaaatgctaatctcttctagaaactccttcagtgatatatccaaaataatgtctttcctgctatctaggcatcccttagcccagtcaagctgacacataaaattaaccatcacagccagtggtagaactggaactaagtccattctgtttatccccaatgtttatacttttaactagtatacactcattaatccacacacacctcactgcatctgccttcccacagtcgaggggtttgattgtgcagggccagagagttgcagaaaagagtagaacagcttgagtctgatacagagaagagctcaagtgtaatgacaaatggtgatcgatattatactttagtatagagacaacatagggagtgctgaggactgtggagaacttttctacttctttccagtttgaagggagctgcaagcagatagctctagtcaagtctaacagtttgagaaggtgggtacaatgttgccagctatttcaatttccaaagagggaccagaaatcaaaattttatagaaacatatacactttttaaatgttagaaaattatacaatttatcttgagaataataaaaacatatctgtaggttaaatagaggcagagactaaaccagcacaaacaaaagcacacagatacacacacacacagacccctatccatctacctaatcatcctttacaggatagtacattatagtattagctacattatatatgtaaggtgtaatttgattgatcaataagcaattctttgttccacatatagattcttaattttcaatatatgacatgctgttgggaatctattaggctatttattagggttgcatgttaggtgagacagatagtcatattcatgtcttatttcacttaaatgttttccaatgcattgtgcatacacacagcatattacttttagggaactacaacataatacatgccaaaaaatgatgtacaaataagtaaaataagaaatatgggtgtgccagggagagggtaaggagcagtaagaatgagcatcacagaacttgttcttggaatgagcattcactaaattgatcacaggaaatttgacttttcaatagtgacgagattaaagctcaaaggtgattgaagctcaaaggtgaggaaggtggacaaggttatttgatgcctgtaaaagatcaagtcattaacagtcacgcacactgtttacatgaatgacaattacattagattctacttatagtcaaacaaaaagagctgagaagttttttttaaccatttccccacaatatttggcttaagaatacctctcagctctttttgttagactataactagaaaccttttccccacaatattctttaaagatcaagaaactaaatacataataaaggaatgggaggaaggccccaaatacatattataatgtcctgggaaataattgcaattataatgaagatgtaaattgttttataaaaccctatatgcaatgcatatttcatacaaaaggagcctactaaagaggaatggcccagggaatgttgtgttgaaagggaatatttgtagtggaaaataaataacttcagaagcaaaggcccttgggtaaaaggaatcaatattccatgaagcattcagcctgaaagattcataccctcattccaagcatcctggttgtgtttctaaaaaggggttcaaataacatgtcttctggtaccaccaggtgtgcttgttaaaaatgcagattcctaggcccatgtatcaatcagagtttcgaaagtaagggccaggaaattcaattttaacaagtaattgtgatgatttttatgcgtttcaaaattagagagtcactaatttagagaaagaaactcatcctccactaccatcacagagggaagtcacatgcaataacagtttcagaatgtagcatggaagatcctgtattaaactttaaagcaacaattatgagaaacctaatttctgtgttaaacaacctcttgtaacacagataagagaaacaaaaatggtagcagcaacattagaaacattctactattcagaggcaaaactcaaaacttttagcaactgttagggaattctcctgtttttagtaattgcagatataatttgtgaactctgttcaactgtcacatctgtagataccaggaagttaaaagactgtagcagacatatttggccagctacccagaaactacagccctcctcccttcaatacacacatcctttctcccttagtgagaaccagaatatgttccattatcagcctcttcttgagtagaatctatgcctctccttaacatcagggatgaatctttgttatcccattctaatcaagataattatattaccttcattagttattagttgaggaaaagacacgaatagaattttgatgggcccaggcacagtggctcatgcctgtaattccagagctctgggaagccaaggtcaggggattgcttgaggccgagagtttgaggccagcctaagcaacacagagagaccttgtctctacaaaatatttaaaaattcactgtgtgcccggtgcggtggctcacgcctgtaatcccagcactttgggaggctgagacgggtggatcacctgaggtcaggagttcgagaccagcctggccaacatggtgaaaccctgtctactaataatacaaaaaattagtcgggcgttgtggtaggcacctgtaatcccagctactcgtaaggctgatgcaggaaactcgctttaacccaggggacggaggttgtagtgagctgagattgtgccattgcactccagcctgggcaacaagagcaaaattccatctcaaaaaaaaaaaaatatatatatatatatatacacacacacacacacacacacacacacacacatacacactgtgtacagtggtgcacacgtgtagttttagctatttgggaggctgaggtgggagaattacttgtgcctaggagttcaaggctgagatgagttatgatcctgccactgcctctgtacctcagcttgggtgacacagtgacaccgtgtatctaaaaactatgacgaatgaagcaataaagaaaatctgtgaggagcttctaagaataatctcctttgtattctggcttctagacactgttttgtgggctatgatgcttgaatctatggtaactcttttgcaaacataaaaaaacaagacgagagacaaaaataaatactatattataaggattgaaaagagagagggatgaggggagggagagaagaaggaaggggagagagagggaagagggtgcaaggggaaggggagggggaggaaaatggaaagagggagatggaggcagagagggagagaaaaagattgagagaaagacaaagagagattagaaagaattagggcccttggtggtatatatgaacccctgagttaaccctttaactactctaccacatgattgtgcaggtcctttgggcaatgaaggactcctgtgggtttcttcctttactgacgggatgtttctagataaagaaggtgacgtggtctcttttccctgtaaacacgcttgtatctaggcctctttgtaaacagactaataatatttgctagaataaaaggtcctgacatctagaatgttcttagcaggatgtgcccagctaagaattattaataacaaataaacccataatctgtggaactgtgaggcatatgtccctcaaatatactgcctaagtcaaagtctaaaatgaagctatttcatagtctaaccacttccttgcttataaggtaatatgtgaaccttatttgaaaactctttgattactgtgcatgtccaatgcaggaagaaaagtcctggggagccgcacaggatgtccaagacttctacctgatttgtttgatcctccttttcatctgcatcctcgatattattaataatggtgatactgggtaaaacctttacttcagatgattctgatttgataatcttatcctttatattggctcatcctattaagtaagagaataattttttgttgtttttcatgtcatttcaaattgtgtcttctgcatatcaattgtgattcttcccatggaaagtaatgagattgcaatagccagtgaaagaagttaagcattaatgagacatacaagataaacaaggaaaacaaaagaagcagagagaaatctaactgaggaacttctctagctaagaatttcatcaatagccagtaagaagacattgttaattatcacaataaagttatacctatatttttaaaaatttactattagatattctttgggttttctcccatcaagcaaacatgtgatctatttttctccaacttacacagatgggtccctattgttttgaccagagatgatggtaccatatctggatacgtgacaaaaggtgagcctatcagttactcttctctgtgaaattacaaatagggctaagagtgtaacaaatctttgtccattgccggacatgaaacatgcaaactcttttattttctgctataggacttaacaaagataattggtatactggggtgggggaaagcaggaatgctgtgaggagaaatgagcagtggacaggcagttcaagcaattttgagaaagtttatatttcatacattcccacaattctaatacagctatatatatatatacaacaaaatggtataagatagaatgtggttagttagtccagtattgtttcagttctcctcaacaagccatttttttcatattaaacactgatttttaaaaagtcatttcaatcattacactagagacctgacatttgagtttatttatgtgggaaaccaaataagttgatcaaagcaatttcttcttccaaccaaggacaattcctgtttgtatgagctagcccatgcatagtgattctgactcacaatccaaatgtacaggaagcaactaccatttgcaggtttccattaatctttgcacatatttgcaaaatatgaagaaataaaagtattttgtataagaatgctctaaacatttgtgtatgtgtgagagagagaaagatttaagtagatctttaagttggaagaataatgctagaagctgcaagtagagacaggagaagcattaagatgatagactagtttctgctaaaatcaaatattgtggtattgcaaaattcaatttattgcattaaaatagactttagctttactcaacatcagagaaataacacaatgtcctctctcagcctttcatttatctcgttggtagagaaaattacttaggcgactccatttgtcccattttgaataattctcaactttagagaaatatactcgtgtcccaagtccatgactgatttacagttaagttagctccttaaaataagggcataaaaagaatgcaaaaggtaatccaggattttaatcatgatataaattttaaacgaaaaatgtgaaagaaaataatttagtagagcaaaatagaaaaatagaaaaacaaaaagtgaatagagtgacgaagaaaaacataagtaacatatatgaaggctaatttcttgtatcttgaccttgtaggttttgaaacattaactgcaattgaatgcatcgctatatttgcatttattttaatttcaatacaacaaaggtgatgtactctatatttttgtacattttagaaaaacactcatagaatagtcaccatattatgcctctgttatttagagaacagttcaatcatagctaatatgggcccgtcttttcattatctccaaatattattggacaatgataaaagtataaagtggcattaaccagtgagaatgacattagagatattatacgtatgatttaattttacacattttagctacacaaaatgtacaacagagttatatgtgcagtgcttgagagaattaaatctaattttaaactacacaaaatttgagtaaatatgctaaataatttataaaattaaaatcctcttttccctgcagcactttaaaattccattctgcatttaagaaaagcatggaataagctcccgatattgatgtctcgtaacccaagatcaacatataaagataaagtgaacagtaattctttaatgacgtatcctgaacatgcaaataccacacccctacttttattctgtacttcttctaaattttacttgaaacctttctttgttgagagccacaatcatctgatgatcatccatacctttcaatatttgatttatgaggcttacatattttatacaaacttccagtgccggtatgtttctcaatagttagtaccattttgggggtccctagaaaaattccataccaaaaaaaggattaactagcaagaacttcagagatatagtagggctcttgttaatcagccacaagtaaaagctgcaacacaatagagataactctctaagacttgcctaggtcaaaacaattgagcaaacaaacaacaacaaaaaaccttcttccctgccacacttcaaaattccatgtcaatttctacttcctcccaccacaatatcttatccacccctatatcgtgacatggaagttgggaaggggagaaacatcaggagaagcagtatagtagttcaaaccactgtgatctttattttttttttttttgtcctgaggaagttccttgctatctttcatgagctctggcaatctttagaaagttggtttataagattttaatggtatagtctgtaatctacatctttggatttagatttcttgcccataaaagactttactgaaacaatcccacctatcaagtaggatctactaggatagtgggaggaaaatgtacttaagtacttaagagcacaggcttgaactgagtttgaatcctagctctatgacttaatagctgtgaaactttagaataaacaattcgtttgttctatatatcaactatttctctgtaaaaatggggggatcaatagtatctaaatcatataagtgaagatcacgtaagataaaagtgagaaagtgctatgaaaagtacctgaaaagtattatgaagacaacatgaaaacaataagggaacgaaggttttcatatagtgtgtatattcatcatgcatcaaggagagagtgttatttaaagagctttctgttatctgtgacataaaatttaatgttggaagacagatcctgaaatctttctttggagagatggcccaacctaatatggactacttctaactgagaaattaagtatattggtgaaaaactataaagtggattttctggtttccatttgttggaaccagggaaagctattattttgtctccatatttttggaaagccaaaaggaactcccaatacgaaaggggagagtaggcttcagcaacagggtagtggactgcaaactaagaggtgagctttaggtgatggggtatggacaactgacttcaggagtagaagtatcttatatctcactctacatgttctcatccttggttgcaattactttcagttattcttagatcttcatcaaacattacagcctggtgttatctgtaatgtgaagaatgaaaagagagtctgtgtccatgcttggaaaaaaaaaaagcatttggggaagaaaatagagcagtctagaaaaaccttgacaagaagggaaagaacatggccaacagagaagcccggagtagcagactgaaaaaatatgtgacaagcaactagtaagacagacttgttggaaccttgggcatttctcaaaattattaagggtgtacaaacttaataaaagataggaagcagacttcctgcaatcatatggctagagaatgtatgggagagtatcctttgaatttgggtactaaatgcaggttaacctccaaggctgccaaacttgaggatactgcatgacaaatgaacaaataagtgcagattggagggatagtacaatgtttaatcctgttggtgaattttcataccacacaaaccaaaatcaacatgtggaaaatgttgcataatcatatcaaagttaaatgtaaattatattcaggttacccatagtttgggcttctctataccattgcccttctgtgaataaaaataattgaagtaatgaatagaacgaaggaccatttagaagctcctcacatgtgatgatattatagaacaaaaagtttagattttcacatcatatacttagtagtccagggggaacacaaaataagaaagtgaacatttgagtatcacacatgactctataactattagaaatactataaactccattgtgatttaaacgtgtctaattgaacatacatatttaacagctctccccaaactctaatagaagtaaaggaaaaatcatggcaaatattcaaaaggatacacacacaaaaaagaaaatagatattaaaatgtcaacaaaatcttgggagccaaaacaaattcaatagacttcaattataattaccaatgaaaaatagaaaaatgataattacatatggggcaaggaagcagcatgagaaattaagagaggacaacaagaatcaagctaatttgcatcacagaaccttgacatgtctcaaaaattcgaggaaacatgtactctgaaaccatggacataaatgggttaagttaaatatatgaatattcagaagtgtgtataaggaccagctcagtttcaaattcctttcccaacttcacacaaccgcaattcacccatttcaatagaagacaggaggttaattctgttgaaccagagaggacttgctttcaggaaactgagcacagttgagggaatggtagaggtactggactgaaaacaggagaatgatataaatgaaactggtgaaacgagtctccattcttgcttgactcctgtcccctatgcttgagcaggcagccagatggtttccctctgggtaaacagatgtcccaacagaaaaaaacgaaacctacagacatctgggaaccttctgggaaaacatctaggactacacctaatcactttacagtaaactagacttattaacaagacctacccacatacatcacatacatagagattttaatcagcgttttgtttcctaggtcttcaacttaaattggtagccagagaaaaccaggtgtctgaggaaagcctcaccttgaaacaatgatcaaatcaaacaaacagtaaatatacttggaataaaaaaaaaagacaatgtcggccaggtgtggtggctcatacctataattccagcaatttgggaggctaaggcaggaggatcacttgagtccaggatttcaagaccagccagggcaacatagtgagaccctgtctctagagaaactaaataaaattagccaagtgtcatggtgtgtgactgtagtcctacctactcaggaggctgaggtaggaggatcatctgggcctcggaggtagaggttgcagtgagccatgatcatgccactgcagtcagcctgggcaacagaacatgatgctgtctcagaaaaaaaaaaagaagaagaagaaaagaaaagaaagaaaatacaatatgaaaattgaagaatgctttaaagttatttctaatgcatgcagatatacaagatatggcataccagaaaagaacagactataaaatgaaatgctgataaagctaaaataacttcttgtatgttcaatatatgatagcaaaaataagaaaaataaaatcaatagaaatgttaaaaggtaaatatgaggaagttaggataaaacataaaaagaaaaatgggaaacaatagagaaagataagaaacttagactatatatacaggtataaaatatgcaaataatggaacttacagaatgaaaggaaaatatgttgggcagggaatttactaggaaataataaaagaaaattgccatgagtttgtagattgaaagttgcccagagggtcaagcaggatgaatggaaagagggccacacaaagtcacaaaattgcgacatcaggacactgggaataaaagttacaactgtagagagataatcaaaaatccaatgcctttcttctccctttgaagctatggacactctagcttctatgctttcttacaaaataaaagaataagcatcaactatttaaaaagtgatcttcccaaaatattgcttaaagattacatataatgcttccaattttatgattccaaagaaaacaacataactcagaattttgtagttaatccccctttaaataaaacaactcttaatggcccgtgaccataagaggtattttttacctcagtccttttcccctacttcttactctgtgacaaaactgataccaaaacatataaattatttcaactattttcttcagtgggaaaatctggcctattttacctttttttgcatttttacttggcaatacttttgtgtgttgggggggctctttcttaactttttttttttttaattgagacagagtctcgttctgtcacccaggctggagtacagaggcatgatctcagctcactgcaacctccacctcccaggtccaagtgatccttttgtctcagcctcctcagtagctgggatcacaggtgcatgacaccacacccagctaatttttgtatttttagtagagatggggtttcaccatgtcagccaggctggtcttgaactgggctcaagtgatctgcccaccttggcctcccaaagtgctgggattacaggcgtgagccaccatgcccagcctcttttttaacttttattttaagttcaggggcacaagtataggtttgttacacagataaacttgtgtcatgggggtttgttgtacagattatttcatcacccaggtattaagactagtacccgttagttatttttcctgatcctctctctcctcccaccttccaccctccaccctccaaaaggctacagtgtgtgttctcctctatgtgttcatgtgttctcatcatttagtgcccacttaaaagtgagaacatgctagttttctgttcctgtgttagtctgcaaaggataatggcctccagctccatccatgtccatgcaaagggcataatctcattctttttcatggctgcgtagtattccatggtgtatatgtaccacgttttctttatccaatctatcattgatggacatttagattgattctatgtctttgctattgtgaatagtgcttcaaaaaacatacacgtgcatgtgtctttataacagaatgattgaaagaaagtgcggcgattccccaaagacctaaagacaagtgcatttcgacccagcaatcccattactgggtatatacccaaataaatacttgacaatgtttgatgtctagatatgtacacattttctcctcataattatcaaattcccatttctcaattactatgattttgtatatctaattttgctcttatcagcttgagaaaatcttatctgcctttctattcaagagattcaaaactatttgatatttttccaacatatggaaatatggccatctataaccactgatgtcatttcatcttcaatgtgagaagtaatgagtggcaatttgctcatagagctttaatctgaagaccaaaatttacttagactgatgcagaggtggcacaaaaacaactgtctgcagtaaactgaatgtattaaatacttcctaagccactattctctgaccaaagcatctctgtaaatttcctcataagtgggacataaagcagctatagaaagctttaattctaaggttttctgtttgaagtaacaaaaacacaaaacatataatggaacaattccttacactaatgtttagctgtacaaaagtacaaatggcaagccaccaggtaagcaaagatctgattttatcaaaataaagttgaaatggtagtgttcagttacaagaaacctactttcctaatgccacacctagatgcatggtctgaaaatagaaatgaagattttaaatttaatttatcccagaaaatttgggaagtataattaccctatctgtagctacaaagcaggctcatagacagtttcccaaataacatgtaatttttaatagtgaaaatttcaacaagtctagaaagtagaaagggacctgaaataaacaaagatagatacacagaactcctaggtttaggtagttttcttatcatgagctccagatgtcttcattcttagtcctgggactcgctcatctttttgtgctatcgcatcaggataaagatggggaacaaattaacagagaaaagaagcaccagtgtaatggctctgcagccagataatgcagagatagcaagtcatgttcacagtgcaaaaggacaagcattttctaaaataggaattctaatcccactgggtttctctgtgtgtgaatttaacctttagaattagaatttttgaacccctggaaatgaactaatgctttgtgtaaactacataaaacagatggaagtgtgttccaggcagcacatttaaatataaagaccatttctgtacctgcaaaaactgctgcgctgcctcaaaggataaatccaagtttaacatcgcaagtgaagctagcccacagcacagctcaaattcagagaagacaagtactgtgattcctaaacatttacattatcacagaaacaagaagtatacacttggtctaacataaggactagtttgtttttttcctaaaagtgttaaactggaccttcattgtgcttcaaacatacttttcacttgtttaatctctaggttaattacagattttttgcagttttcagtactgatgattagcaatagaaaaataggtagctacttcaaaaactatttgagttcaataattttcatttatttttgttttaaaagataaatatttgatagctaaaaaataatgctttattatgtcataatcataatttaaaatgtatatttaatgctatttcctaaagagaggggcattaatgttaaaacaaagttagtagctatctacataatgtacctgaaaattcacgtctcgttaactaccagacctgttagaattgtgctaactgtaattacagtgagaacttgactggagataagctagcagcaaaaggcagaataaaattatagaggaacagagttaaaattcagtttgttttcctcatagaaagataatattcaattaatgatggaaattgggcctgtgttaatcacggcattgtataaatcccccaaatcacaacattaaaacctaagctcaagaaaggggtaagaaagtgaaagaacacaaggtatcttaggtggcaggagatgagacatctctgttctcataataaatcctaaatggcaccctgagataaatacattacctctctctggacaacatggactacgtactgacatgcaagggaactagaaggtgacattttttgcagctacacacgtgtgttattttgattttctttatacatttacaaaaaaaatctatttctaatacacacatttctgtatcttaaaaggtataagatggtagacattcaaagtttattttccaagtatttttaaagctaagcttatacctaaagttagaaatgtctccattttcctgctgagtcacacagtgcaaagactagccttttgccaggtttattgaagcattttaaataattatggaagattttctttcatctaaaaattacaactcattatctgttttccctcagtacttaatcgcaacctgtagtactaattttaacccctcatattattttaataaaacccaaccacaaattttagtgtaagaggtgtatagatttttttaatgaaaacacctgatgacagtctcgtctctacttcattagattcacaaagatctataactccaaaagtttaacaaaaagaggcaagtaaatatcagaaaaaagtatctatttcaatctttttaagttaatgactttgtgtttaatgtcacaattttatataccaaagactaacaccgtattaaactaaaaacaggtgtcataggctatgtagtgtacgtgtgaaaagatgtcacatgatctggcaaataccaccttgctccctctgtctgccacaccatttttgtgagttgctgctggctgaaggtttccaaaatcccaacagaaattagtatttgatatctgagaattggaaatcagaattcccaggaatgttcataaatttctaaaatcctaagttactcctaacatactcccaatgttctacattattattactaaaaataagttactcctaacatgcttccaatattctacattatttttacatattggtagggatatatacaaactatgattaatacattttaaaaaattaagtttacaaggaaacatagctgataggaaatgttaaaacattgaacatgttagtgagtagtattggataggatttgattagctaatattcagacttcctggcaatattagtgtcaaaatcactacacagaatcatggattgaaatcaccaatttgagaattttttagttcccaaacttactatttctgggaacatcacttataggattttaatcaagtatactatgcatataaattattaatgcttattttattggctggaatgatgcattgtcaatagcagacattcaaaaacacacttttaaaacatgacaataactgaaagtaagattgaatgattacgttgtcaccattcttctatatatattctgaacttggttcccagtaatgtcaaccttgatttttgactgacttggagtctgtgcttcctgattttgcttaatttccacttgactttggtggattctgaagtttcaaacttgtaatgtttttctgttcacttctaagctgcagttctctcatggggataatagtacattattcctgtgttctaaagctcctgattgatctttctcattattccagactcagaaaaaaatgtatatttctgaagaaatgttaggaagcaattcccacatggaaacaccactgaaaattacttgtgagttattgaagaacacgtgtgtaggttattcaccacattagagggtttaaggccagccctgaagatgaactttcaatcacaggattcaatcataactcggccttacctccattacagagaagaagtatttagaagaaaggaggttaccatttgaaactaaatatttgtttatattaggtttcattttcaatattagttttaatttcttaatacataatccatatttctttgaaaattgaaactctgtgtagataataggataaaatagtattgcagcacttataacctcactacctatagattgctcacaattacttccaggcaatccctctcatgtgtacacttgatgttgtactatttatgcacacatgcaatatgttatgcatgttgattcatcagcaattttgtcaataaatttatagaatatatcaattgtttttatgattgtattatattctattgcgtagacaacactattacttattgctgtatatttacatgttttctaattcatcattatagaaatcttcaagaaaccttcttgggcctgccaccttttgtattttgcaaactgcttttcaatattttctggccttgcaataaaatacaatttatgtaagcatttttaacataataaaactgtaatgtttaataatttcttgatttgtattcctgccctagttatgcttgtttattgttcctcatatcaaatgcatcacttttttgtggtgagggtttattttaaatttgacaatttatgtataaataataaaaaatcatgtttgatggaaagctggatcactttactcttttaatgtcaatttacttaatatagatttaagaaatgtggattcttaatatggattaataaatgtaaatattttacatcatactatatttagcaactaaggttaatatctaaaaatgatgaaatttaaatagtgataattctatttctgggtgctaacttcatcctatcgctttagcatacattattgcagaactgtatgatatacaagaataacttcattttttgacaaaagacagagggccatatttgtatgaaacaacacaaaccgtaaattaccatatttatttaggcatctggtgccaatgaaagttatttataactatagattaatcagtaataacatttttaagatgcctgagcatatgtttaataactcaggtctgggctgtcatgaaacttttattgcctataagaaatgctagtagttttccaggatataaacttttgcttcctagagagtagagcacattatgaacatgtttttaataggacttcattttctgatgatggcaataatacagatgtgcactctcactttttctgccctaggccagacacctttggatattacagatgttttattttagaaaatttttcaactgactttaaaagtagattatacctaattaaaatgcagatcttctactatttaaaaaatttaaaaataatggtgcataatggaacaaataaatgctttgtgaggtaggaacggaaagaactgaaaaggaggcagtttaataaacccctatggagagtgatgtggatcctatatacagggcccctagatgataagaactttccaatctagggagcattcaataagaaaatgcttttaggaggcaagtgttgattctaggtcaatgaggaaatataaacgggaataaacgtgttcatcacaatattatatcatccaagtttaccatttcatctatgtcataataatgatggatctgacagccaagtatataagggatagatctagtacagaagattaaatttttagtgaagtcttcttattgtaatttttcccaggcctaaagttagtttatttcagaacacataactgatatattttactttggtttttaagtgttacaggttgtgttcactgggaatccaactatgatataaagtttagaatgtttattaaggagttccctggggctcaacacttctagagagaagaggaaagaagtaggagtggacacagaaaagtcaactgaacctttagcccaacagcagcttctgccaaccctatgagaagctctggagctagaattgccctacagaatagactaaaatttaactgagataaaatggcctttatatgccctcatagataagttcctgtatgaggtcaacccaagaaagtcccatgacccagggcatttctcttcaactgaggcggtcctcaaaagggctaacaaccaaagtctgtctaccaacagtacttccatcagtttgggtaaaatgtccttctatgaacagaaatctgggcagtgcatcacagcatctaccatatttagtttattttgctcaaaacagaacatgtttctaaatcatggttagcattttttttctcagaatgacttcaaaataatgatagatgaaacccattcatagttttctgactacactctatatggttgccagaagtttttaatctattactgatgtttctgaaagaatgttgaataccatgtaaaaagtgggtttttttttttttagtatgcactctttacagtaaaacactttggactatacccctaaaattggggagatatatatatatctatatatatcttatacatattaatataacatacatttatatggcttatatatatagcttatgtatttatatattgtatataacatgtgtatcagcatatttatattttacaaaccttattagtcaaaaaggtaagagttttttaagtggcgtaattaaagaaaaatgaaatttctgttttttttcctatggcacaaatactacttttgaaaatcagcaatctgggtcctgccttgcttccaaaaactacctttgaaactaatacaagaagaccagccttttaagatagctcaggaatacaatacttcatcttaaataaacaactttcaaaaaaaaatcagagcttgatctgtatcctatttcactgttagttacacgatgctataccttgtgctttgccatactgacatttctcattttttatcataaagccttgcatgaatattcattttttctagcttctgcacagaaaaagaataatcagagtaaacagacaacccacagaagagaaaatatttgcaaactatgcatccaacaaaggactaatatctagaatctacaaggaactcaaacaaatcagcaagcaaaacaaaaacaaataatcccatcaaacagttggcaaatgacatgaattgacatttcttaaaagaagatatacaaatggccatcaaacatatgaaaaaatgctcaacatcactaatcaccaagaaaatgtaaattacaaccacactgagatacaaccttaccccagccagaatggccattattaaaaattcaaaaagcaacagatgttaacatggttgtggtgaagagggaacacttttacactgctggtgggaatgtaaattaggacaacctctatggaaaacagtatagagatttattaaagaactgtatctaccacttgatcaataaataccattactgagtgtctatgcaaaggaaaataagtcactatatcaaaaagacacttgcaaatatgacacctgaagatatatttatcactgtgcaattcacaattgaaatatatgaaaccaaattaagtgcccatcaactgatgaatggataaggaaaatgtggtatatacatcctatggaatactactcgcccataaaaagaagtaataatgtctcttacagcaagtttgatggaactagaggccgttgttctaagggaagtaactcagaaatgaaaaaccaaataccatatgttcttacttacatgtgggagctatgctatgaatatgcaaaggcacatagagtggtataatgggcactggatactgagaagggaaagggtaggaagaaggtgagggataaaaacctgtatatttggtacagtgtacattacttgggtgacaagtgcactaaaatctcacacttcatcacgatataattaatctgtgtaaccagaaaccatttatacccctaaagctattaaaatcaaaaagtgtttctttctattttcatcatctttgcccacatccatcatactcaggttcccaaacattatgcttcctttttagtcacaaactcatttggagaaaaacaagcaactggattaaaaaaataggcaaaagacttgaatagacatttctccaaagacaacatacaaatggccaataggtatatagatgctcaacatcacaaattatcaggaaaatgcaaatcaaaaccacaatgagatatcactttatttttgttaggatggctattatcacacacaagaacaaataagtggtggaaaaggtgtggagaaattagaaatttgaacccttatacacagttgatgagaatgctatatggtacagccactgggaaaaacagtatagaggttcctcaaaatattaaaaatgatattaccatatactgcagcaatcccacttctgggtatatatccaaataaattgaggtcaggatcttgaagagatgtttgtactctcatgttcattgcagcactgttcacaatagacaagatatggaagcagtccatatatatatatatatacacacacatatatatgtatatgcacatatgtacatatatgtatatatatatatagagagagagacagagagagagagagagaatggaatactattcagcctttaaaaagaaggaaattctgccatttgtaacaacaacttgaggacattatgctaaatgaaataagccagtctcagatagagattccacttatatgagtgttctaaaatagttgtattcacaaaagcagagaatagaatggtggttgccaggagctaagggaaggggaaatggggaattgtttttcaattgatgttaagtttctgttaggcaagataacttctagagatctgatgtacaaatgtattacctgtagttaacaatacggtgttatgcagttcaaaatattaaaaggatagatttcatgttaggtgctcttactaaaaaaaaaaaacaaaaatataccttagaaacacaaggatatttttggaggtgatgtacatgttttgtaccttgattgtggtgatgttatcatgtgtgtatgcatatgtccaaattcatcaagatttagacattaaatgagtccaatatggtatgtcaattacacctcaataaatttaaaacattttttaaagaagaatgttatagttctgatgttggctaaaatcaatcggtttgttaacagcagcaacaaattagaacacagacctgctaggtccccaaatttttagtttggaggtacttcgataacatcatgttggaaatccgttttactaagtttggtaagaggtgtgctgtgaatgttcaataggtgacttattaattgctgtttaaaaccagtagtactgaagccttagtgtaatctttgctttgatgtcatgccattctactcctctacatatgacctctgaaatcttattaaataaaattttactatgagtcaaaagtatacttcagcggtatattaatataagaggataataagtatgtaaaaaaatacagagaaagaaaggatgggaaaacaagaatatgaaaatatatttcagaaaataaaatgagaaaatacatgtttttttcaagtgatgtgatgtggtggaaacagcacatctttgtgaggaggtgttgggaataaggaaggagactttgaaattccctagttagttggtatcactggggattaatcagtctattcagaataccaactctcattcctagatacaagcatgtaagagtatgatcatgtgatgtaagtgacaacttgctgtgcgcccccaggtttaagtgaaaataaaagaaaacaaatctttgttcatccttttaaaaaaatcatagacttgatagagaaaaactactacaattatagtaaattgccaagactaaggaaatactcattgaacgaacttagtgtcatttaggaaatgtttagtaatcagtaattatgattttctcaaaataatctggtttaattataactgaaagtttctgttacttttctcccatctcccatggacatcttgaacacaatttcttcattgctttcaatgtaaacattgcctacttttatcagagacagatagttggagaaaatagcaagagaatacactggagacagtcatttattttggtaaaaaaaaaaaaatgattactagtaccaaatagtagttagtttcatttaagtttttgttcttagaacagaaagaagcagtaaataaaagcatgatttcttctgtatattataatactctgcattatgtttctacatctaattaaagtccaaatcaagatacaaattttaattgctttataacctaatttgttccaattccatcaatatttttaaaatattgccattgttttgattcaatgagtatattgttttgtgtctagaattttaatccaaatctttaagcaatatctgtaatattaccattactatgaaccaaattttaattgacttaaaaatgttacagaatataatagctactgtatttgttccttctcatgctgccatgaagaaatacccaagactgggtaatttataaagaaaggaagtttaattgactcacagtttcacatggctggggaggcctcaggaaacttaaaatcatggcagatggcacctcttcaaagggtggcaggagagagaataagtgccagcagggaaatgtcagacactcaaaaaccatcagatctcctgagaactgactatcatgagaacagtatggggaaactgcccccatgatttaattacctcccaccgggtccctcccatgacatatggggattatgggcattacaattcaagatgagatttgagtggggacacagccaaactatatgagctactctattatgaaacatgtatttctataaaataaaaaagtaagcatttttcacatttggctagctataattaataatgtatttttcatggaattcattttagaaatgttctttataagaaatttccatttgtgattaaaaaccagtccattcccagacctatagtggcatgacctcactaattagttatgcataaatttaaaagaaaaaatgtatttagatgtttaatgttggttaatatattaataatttaatgtagtttacataatatgtaacttaggccaagccaaatattgtcaagtctgcttcttaattttaaaataaacctctatttaaagtcataatatatagacaggaaaacatatttaataaaatgatatcacaacatcaggtaagatatattatctgttttgtttttcacatttgtaggtaagttctcgtattcgtattgctaataactatctgattaaaatctgtgtaatgattacaatattctctggttcaaatcacttgacaaatatggtttcatgcccctattgagcactcttttctacaagtctgcctcacgcactactgcgtctacacctttcattcagtgtttgttgcagttacccgcctttcttcagaaatactgcagaattgaggcttatcccatttattttttgtctttctgatgccacatgccaatatttgtatattccttcttatccactaagtttcatttttcactgtcttttagatctacttaaacattttattctgtatgtatctctaaccatccagtcactatctgtcttttagaatagagaagcagatgttcaacaagatttaaatgattcacatgcttaggtaaccaagtcagagtagaaaaaaatacagttacaagacatattctagaaaaacatattttcatgggtggatgtgatatcttttcacctcctatcctccacccaatacttattgtacggtagttttgaagaatctgtggacataggtagccctttttggacaccacctttttaattccaatatgcctcccatacctgattgaagaaactattatcaaagaatatttaataaagtgataatatgttcatattacatcaatgtataatcaatttattattattattattattttgagacagggtcttgctctgtcacccaggttataataatcaatttataaagtagtatgcatagtatgtttatattaacatgtatttattattatacttatatatcatatactacatatgaataaaaatcacttttatcctgtttatacaaaatacatataggtattattaatgtgttatatcttatgttttcatacatatgtgcatgtgtgtatgtgtaaatatatatgtgcaaatatatatgtgcatacacccacatctcacaatgttaatggtttagattatggttatttatctgagatgtttagttacattatgtcaatttttatagaatatgctatacaaacaattacaaaaactgtatgccatcaagaataatctgaatgaccatcttaaaactgggttgactgtctttggttactatcgtctgttaggaaagaaatgattgagcagtgtggaagggaagggtatttcaaatagggtaggtaaatcagctggaataacccaatagattaatgggttgatatattctaattaatataatttctattttccaaattgagtcctatgaaacactaatccacaaaatatttctgaacaaaaagactccatgctaaaataaatttggtgaactctagtcttctcttgaagtttcttttatgctctttagtataataaattttctcaggaattatgcataaaagaaatttattaactatgtttaactcatgtgtcccaaacttatttaatcattaaatagtattaacagcccatggaataaataaatgttctatgaagtacaagctaaggaattatgttcacatgtaacagtagaggacaatttaataaagaatttaaagagagagttttgacattgtggtggatagtaaaatactagttgaaatcaagtaattatagcaggtgatatttcttttgaggaatttaggagttattaaaaatatattctatattcatctaaatttgttgctaaggatgttttggggggtcttaggcccaggggatgtggggaagggaaggctgctacactgctaagcagagcagaatgtgaagagaaaacacttgttatggcaaacagcataactgagaacctgggacacctgtaatatcacatgttcatctgtgatatcaaacaccctcctacataccccatataaaatgagtcaggctccatttaatgaaatagtaatttaaaagaaaaagatgaacaaaagccacatagaacttatgataaagttccagttaacaagtactcctgtctgtggacagatagaggttaagccagaaaggatgaaggtacaaaacaattttttattttatataaatatatatacatatatatattttattatactttaagttccagggtacatgtgcacaacgtgcaggtttgttacatatgtatacatgtgccatgttggtgtgctgcacccattaactcatcatttacattaggtatatctcctaaagctatccctcccccgtccccccaccccaatattttattttattatattatttttctctcaacttttattttcggttcagggagtacatgtgcaggttttgttgcatgggtaaattttgtgtcactgaggtttgttgtacgaatgttcctatcacccaggtagtgaacatagtacacgacaggtagtttttcaactcataccccttcacactcttccccctaccaaggagtccccagtatctattgcttttctctttgtatgtattattgttgtaagactatatactaaaaggaactccatctccaaaagctctgaaatgccttatatcattcgttgtttcctagaccaaagaactattcactccttcatattttcactaaccagtgattgctcactaattccttcctaacttttatatcagaacagtgtttctcaaagtgtggtccttagaccagcaggatcagctacacttaagaatctgtgagaactgcaacttctcaggatctaccctacgacgactagacaagaaactctgagggcatgggacagtagcctgcatttttaacaagccctccagagaattctgatgcgcactcaaatttgagaatctactgcagtagaagaatacaattgatgcctgcctaggatgtttctaataatgatatcagccagtccttgtatcaaatcacaaatctaattttaaataagccaaattttttaaacatagcatttatgttataaagtacgagcagcccaaaatttgtacaggatttatctgaaaatggaattgaaagttggcataataaaacttggtacatatttcctcatgggcctaatgcaacgaaattgtggcaagagaaaccattccaaagaagtctatttatactgtactttaattgtactacagtattgatagcattaacttgaattctgagatgagtgacaatcaggttcaagagagaaatggaaaggataggaaagtaaagaaggaaaaaaataaataggagagaggagaaatggttacccccccttatttggtatagtgataactacaggtataatgcaaaaaaaaaatcagttttctttgactccattgtaactacctacctatatcaatattccaacttttagctggcctcattttcagtagagctgttctccctccataattcttacatcataatattagagtgtgtatattctgcttctaagctttgaaactggtgaaaaaaatatgccttctgggttcaaggaggaaatatgagttaagcaatataacagggagtagtggtatatattgctccaatctactaaagagtactggggttctaaagaattagaagtgcatgctctaatgaatcctttcttgacactctccatgctaaacaaatcacatacatccctggaattaattttccctgttatttgccagtttgtgagtgcaacatctaaaagctcttctcttccacgtgcccccaaccaaaattccaatttgggtgatgcaggttatcttacatgatttctagagaaaatgcaactaaagttaattacttcacatttaactatgaatgactaagaagactactaactgtctggcaagtttaggcagctactcctgattttcaggttattccctgctcttcttctaaccatcaggtcttcttacctctgaattttatcacaatagatacagtagacattgggtggtattttcagagtctagaagaaggacataaacaatctctgtaagtataaataatagaaagtttgtaagttttgagaactgccaatgattcttcacataatataatcatggaaaagacaggaatcttcaatcatcaccacagagcaaacaaccaaggaaggttcctgtgatgattcaaaaccagatttcacagcttctcaaaactggctgctcattaggattcttggtggattctccgtagccaggtgccaccctccagtcaaaataaatgagaggctctgtaggaggggcccaggtattcatatattcttaaaaatttccctgtgtagctgtaattctcaggatagaaaactattgccagagcatcagagttactccagcctccaaatccagtcatgcacaaaagcaaattcctccttgtaattcttctgaaggggttggcaaatatttctttaacttagaatatgacaccttagatatcccatgacatccccaccaggccaaatctactatctgccattttgttcttggattaaaattcagtccccctttaatcttcagcaaactcatactatggatttaatctgtgttactatttgctttgattcaaaatttctttaattacattcatgtcaaattattacatttgaaatatattcaatccacaaaataatatgtggtttcttttactgttttctattcatttgtgatggtttgacaagggaaagataattccataggacatgtacatgatgataatagacttttctactttatataataaaatttggaatgaatagctcatcttcagtacctcaaacgatgttacaagaagggacagtaggaacaggacagtttgaaggaggggcagggtagatgagggcattttacattaaaataggctactcaagtggaccagttttcagttactatagtcacaggacataacccaaaggtgtttataagtgttcctcccaatgaactttattagattaaaatatagccattaaatattccacagaaatgcacgtcctatacttgtctttgggtagtcctatagttgtggtcatttgtcatagttaaattatgcccattctcaaaatagcacatcagttccaagggattataaaggtcagcttttactagcatgacagaaatcaaagggtgatttcatgttccttaactagggacaaaaggtcacaactattaaatctttaaatccatgtgctgtgatgggctttatctgttaaaggaaaaagaagaattcatgatataagcttaatctaatttatgactgtataatcaggaacaacttaggtgtttaagaggtactatattctttactataacacaaggctcaatagttaagaagcaacaaagtaaacaaatttggatgactggctatactaacaccatttcaatttcctaaattatcttgtccttcacagaaattcatacagagactgtaagaagtaaatattcacaatctcagcatctcttacagctaaggatggccacatagcatagcagttcttgccatgagacataggcagcagtctgctgaagggagtctgaaagagatacaattggtggtttcttctcctttcttcaggcctcaaatagtagctgaacggtggctgtcagcttgtaatcagaaagaaaaggcaaagagaatcatcaagacaccagtcctgatagcactgaaatgtcacaccaatgccagaaaaggcctgcctctagatttcttgttacgtaaaatttattgaggacatagttagttggttattcttttacttgtagtaaaatgcatacctaacttaaatccagcctcaacaaaacagtttttattccaaatttatatttttcccatcattaatagttccagtattggaaatatttgccatacttaacaaataaatatttaataactatctctcgaaaaagaaaaaaaaaactccttatcagtaatattggccaacttttatgttataaataaccctactgtattagtccattctcacgctgctataaagaaatacctgagactagataatttataagaaaagaggtttaattgaatcacagctccacatggttggggaggcctcaggaaactcactatcatggcagaaggcacctcttcacagggaggcatgagagagaatgagtgctgagcaaacggggaagccccttatgaaaccatcagatcttgtgagaactcacttagtatcaggagaacagcatgggggaaaccacccccatgattcaattatctcaacctgttcccatccttgacatgtggggtttattacaattcaaggtgagatttggctggggacacagagccaaaccatgtcacccaccatgataattttaaaataccaatatgatgtcactgaatgcagagttaggaaaagattcacaccattgaatctcatgagtcaattccaaacagcctcagcacaccactagatagtcccctaattactaactacagtttcacgaaactattagagttcattgtttttactttcaatttcattgtaacagagaacagagtttatatagacaggaacttagagctcagaattattgactgtcaagataaattggctacatttattaaattgaaagtagctatcataatttatgtaaaactttcagtaggaacttagaagttgtcctgtctcaagccaaatgcactcattaactcaatacgcataatttccaaatgtctcctcgtaggaaagaatataatctaattcactctcatatcagataaaatttaatacatagatttgaaaacaatgtggttataacgttaaataacttgcatggaaaaatgttttagctctcacaaatatccgtaactctatctgtgatcgggaatgagaatgcacgattctctagtcttctaactaatcttgcaataggactgctctcatacccaattacctaatgagagtgaaacttacaatatagtacaaaatactttagtagttattatctatgaaaagtattacctacaacttccctagtaaagtctctgtgcagaagaattctcacatattcacgcaaagcgaaatcttaacactgaagatttttgtttgtttttgtttttactcaccaaagcaggtcttctacaaacataaacaatgaattacctgcttttttgggatgatacgagaatataattttcctgggatggataagtacaggcttcattaccaaagtgactacagatattgaatggcctagtaagaaaatattttcaaatgtaatagtgtgcagttctgaaaagaacatgcctttcaaaatgtctctgatttctcgctcacattttcccttgtaaaatccccagtagctttgtcaaatttgacgtttgtattattctgagagtatctaattgttagtggtatagtactataaggttacaatttaagagcattagctcaaactgaaaaaataagttcaattacattatattcttgttttaagtaaggataggtaaaatactaaaggtataaatctaatgtgtttcaaaatagttattttgtctaccatttatatattactctttgtaatgagctctttataatcatgatgtatggataaaataaaatctatctacctacctttggatatagcaatcttttatagttgggatttgtaataaaatatgaattatatcaatgtgaaattggtcaccagaaagatctttttatagtagacctcaagatcagatcaaagataatctttattccttttttttaaagataaaaactacttagctgattttcttctgaaaaaaaaatctgagtttatttcaaaaaacctttcatgacacaaacccataggtacattttattcaattattcatgtattatcctatgccagtaaaagatctaaagatgtagcaagatgctaaatgattacaaaccacaaaaatgtcataagagaaatcagggctaattaaatttacaactgattttaaaagattaacagcatggagctgtatatgttacactgggatatttctaattacaggaaagcatccaaatcaatagatcaaatacccatatttgctgtttccaagcaagaaaagacaattgcaaattcattgtcttgaaatgcttttaaacactgagattttacccttaggttaactgtagtttatgtctgaaagtgtaaaagttctgtttctgtttcaggttattcattttgtaataaacaattttctcccaaagcacagggcttcccatgggtagtactcacattatgattgttgaagtcacgtacatcaaccataatcagtcaaaagcattgttccttgaggaaatgaattaagagtatgcagttgtgacgggagaaaaaataattgtcaaagtttcacattgctatgactcctcatcaaatgatgagctgagactaatgtataaaatcaatctaatgaagcacaaacttgtattatcaatgtacattataatcatctctgtcttcaattttaaaaaattctgattacaacgtaaaaaaatcttcaatagcgctacaaaaatatgtttaaacaccttacataaaatttatttttatatccctcgaggcattgttacaacacgctcttgttgtctaaatttcccctgacatttaactaggtctagacacaatctaaacaaatttttaagtgtgctttttctggtattactgtttgccccaccacattatatttttgctgtgcacaacaagtggctacaaaagaaaaaaaatctttagtaatagtagccaccctttaactttagaattaacaaaacaatatcaaaactgtaacatatttatatatatacacatatgtgcgtgtgtgtatatatatatacatgtataacaaaaatgctggttttataaatgtacagaaactaaaatattcaaagcaaatattagtttatcctttacttgagggactctaaacccttaaaggaaatgacctatcaaaaatacaaagatatatattgaaaattagataacctgttggaccatctatatattactctttgtaatgagtgacaacacaccccacctgatttagattcctaacaaaagctgaatttcacagataaaaatataacaattcaattattgcatttttaaagtgactctcaatagtagaatctagtatggaatgttacatatacgtagattaatttttctttagatatgaatttaaactacccatttccaagacacacaaatttgcatgaatgtcgttttcagaatatctttgtggatccttttcttatttcccccatgttctggcaagtttagatgtagcataatgataaatagaattaatttgtagaattaattcctaaattaacacattttttccaaaacaatgatctgcaacagatttatagtagatatccctctgcatttttcagataattatagctgcaaggttatcgtccaataacatgtataaacaatagcaattttaaagcaatgtatgaaactacccaacatatttttttcacattattattttagggtatctacttaaagccagttctattaaccttggagctgaatgctaagggcattctatttaagaaagttttccattcttcactttaaaatctaagaagcttgttaaataacctaaataatggagtgaaaaaagaaggaaactgtggttttaaattcgaaataactgatttctccccaaaactgtccgaagcaccattgttttgtgacttatagctatcattatcaactcgtactacttgtaaaaataccttactaaagttctgaagaaattctgctctgctatcttctgaacactttgctggtgtgcaatttacacaactcctggtgtttcttactaactttcgttttcttttgtgatctttcctttaacctcacttcagaaatatacttggacagtgacttcatacctctgtcctcttcagcatccagcaatgtacataaagaaatcttgaatggtcctgtgattttaacgtccacaatttgctgcgtgtccaaaggcgaaaggagcgggctcaggcagctgaaaaacttcatccttagagagagcttaacagctgcttccatttacagctttaaaaacgtatcctggtttacaagagtttgcatatgtaggccagactaccaaacaccagaagatttattacaaatgaaatttacacgtgcatgggggtgggaagcgctgcaaaaaccttagactcctcacttctgctgctttactgattttcaactcgtatagttgtacctcgggcatgcaagtcttcctgtctagcgctctgacgttttccttcagcacagctgaggtgaaacttctcagatttcttaactctgcacttggccacgccctgacaaggcaagctgtccttcgccggccctccctcccttcctcaagctaccacaatatttattttaactcaatctgaccaatcctttgtgtttaatttttaaaacagcctaccatcctataacaaaattcaatattcagtgggctttctttaaaaaataataaataaaccccccactgatatccacttggcctaaaaggaaaagttgggtttctgctttccctgagagcagcactcccttatccctggaacgccgcgccctgcgtggttccccgccctccccacgcgcgggggcgccctgacagtcccctgctgctcctctgctgggcgccacaactttccccaacccgtgccaacttccagggcacagcctctgcggagagtagcagggtacagtgaataacccagacactaaaaagcaaggcagcgggggtcctaccagcgcggcttttgatgacgtcggtgaatccgtcctcagcggcattttctggggtctcctgcagacccctcagctgtgccataaccaaacgccacgtgcctcagcttcctcacgccccaaactttggaaggcaggtgggtccgcgtgcggtccgtttgatgctctccacagcaggtctcgctgaggatctagtgtgtctgaggatggattttccctcctccctaggccctcagccacggagatggggatgcggggggcgcggggcggctggggggagcttgaaaacgcagaaacacagacaccttagcgtgggttggttgaaagagggcgccgtcaaaatgcccaccccatccttagagacgaaaaacaggtgctgttcccagctcctggctctaaaatagagtgggcgaggcctggaaggtgaaagctgaggagggacctggtggtcaatacacccacaagcaagttgacgactcgcttttccacgctgcgcagaatcgatgcaaaaacaggagcaattagggagccgcttgccaaaagcagcacatgaggtcatgaatgatttagcattgccacttagaagatgactacactgacaagaagggtcactggttttagctatctgggtcacttacacgtgtgtaccccacttttgtatcctgacttgagtgcactgaccagacatgggtaatatatgccaaggactatccattttcttaggagatttcaccaaagctacccactcttctctcagtgcatatgttcactctgactgcctcctccattccttcctcccaccactgaggctagaattagattggactataaacagctcgtatgactttattttctaaaaatttcagaagtgactttcatttggttagtatccttactccctcccccacctccccacacacataactcatcctgcatttcttcctgcagtagcccaataactttaaatcctatccatcatctactgaagaaaaattaactttgcaagaggaacttggcaagggacctagcaatagctaaggattttcttttcttgttttcgtctgcattttcattcaaagtagatgcttatccttttctaaaacactggctctcgactatgactagacattggaatcatctgtggagttttaccaaaaaactgtttcctggtttccacacccagagatgccgattaattgttctggtgattccaatgtgcaaccaagttttaaaaacattgataaaatggcctgtacacagtcaatttggcgccttctttaagacaattttgccagcgactctgttccattcctattataatacctttaataaaaacctaatatgtttgccgtcctgtttttcattgccaagttgacccttttcatggcagtggatactttattttgacaaaaacttagtggttagtcttgactacagaattttcttagattcaacctgcgctgactctcaggatggattgtcaactgggtacctttcaattagatcttgatcttgagaatttatgcctattggaaatctttgttgacagaagacctcttaggtttcccaagtgcccattttttttagactcgtcagttctatttttagcaatttcaagtgggaaatatttagaattatagcacagctcctattaaagagaggtataaaagtatgaaaattatccagaatttaaaaaaaaaaagggttgtgacatagtacattttatatcatcaagccactactattagaagaatatggtattggaacaggaagagacaaaatggaaaaacaaagtagtactcagaaatagatccagccaaagggaatgtactaaatatgacattttaattcattcattaaaaaactgaatatataatgattatcttttcataaagttagactttcctaacttaaactaaaaaaattctagatagattacagattcaactatacaaaaatgaaaccaaataagtgatgaatctatagcagtttgagttatggggcattcttaacccaaacactaattccagatgactttaaggagaaaaatgggcctggggcagttgctcacacctgtaatgccagcactttgggaggtcaaggctggcagatcacttgaggccaggagttcaagaccagcctggccaaagtggcaaaaccacatctctactaaaaatacaaaaattagccaggcgtgttggcgccagcctgtaatcccaactactctggaggctgaggcaggagaatcacttgaacccaggaggcagaggttgcagtgagctgagattgggccatcacgcttcagcctgggccactccatctcaaaaaaaaaaaagaaagaaagaaaaatgacacttgctactacataaaaaataaatatttctataaagccaaagatgttacaatagagcaaaaagacaataaactgagaaaatacacttagaatatctatcacaaagacttaatatctctattttaatacaagtctacaaattgatttgaagacagaaatacaatttaaaaaatatataatctgaacagaaaaaccacaaaagaggacaggcaaataaccaatacaattatgaggaagtagtcaatattctcatagtcaaaaaggcaaaatgaaataacatttcctgcccatgagctggacgagaaaacaaacagatggaataacattcagtgctggaatgggtgtgagaaaagaagctcttaataatctctactggtgaagtattgatacaatattttaagaaagtaacctgagaacagctatggaaaagtccacaatcttttgcccatcaatccctccttaagaatctatcaaaaataaaatcactagtatgtaaggatatatgtaagattgtttactgaagccgtgtctaaaagaatacattcattgaaatcactctaaatgtctttcaactcagaactcactgaagcaatctgattataccaaataatggggtatttagtacctgctaaaagtatgttatgtaccttatacaaattattatcggactaaatacagtgctatattcgaagaacaatatatcacaacaaaactgggtgtatttgggcaaggaaacgtcattttttttctttttcatttcagaattttgttttaatttttaatttttgtgggtacagagtaggtatatctatttataggttatatgagatatttcaatacaggcacacaatacataataatcacatcagggtaaatgttggatctatcacctcaagcatttatcctttctttgtgttacagacaatccaattatactctttaagttattttacagtgtacaacaaattattgtttactgtagtcaccctgttttgcaaacaaatacagatcttattcattctatctaactatacttttgtacctattaaccatccccactctccatcccattacccttcccatcctctggtaaccatcattctactttctatcttgatgagtttaattgttttaatttttagctcccacaaataagcaagaacatgcaaagtttgtcttgctgtgcctggcttatttcacttaacataatgacctccggttcgatccatgttgttgcaaatgacagggtatcattctttttatggctggatagttctccattttgtataagcacgacattttctttatccattcatctgttgatggacacttacgttgcttccaaatcttggctattgtgactagtgctgcaataaacaagagagtgcagttatctcttttatatactgatttcctttcttttggatgtatacctagcaatgagattgctgaattatatagcaggtctattttcagttttctgaggaacttccaaagtgttctacatagtggtggttctaatttacatttccatcaacagtataagagggttcccttttctccacattctcaccagcatttgttatcacctgtcttttggataaaagccattttaactgggatgagatgttatctcattgtaacacttgaaaaccaattgatgtgacccatcacattaaaaatatgaaggatgaaaacaaatataaaaaaagtattggaaaaaattaattccctcacatgaacacgtgcactctcgcgtgcacacacacacaaacacacacacacccttcctgggaaactggaagtagaagagatgtaacttgatctgataaaaagtatctataagtaatctacaacaatgtatttaattaatatactacttaatataataagtcaggaaaatgaaattaaaggtatacagttagagcgaaaaaagcttttattatttacagactaaacatgcatagaaaattcgaagaaccatcagataaaatattagaattaataagtggatttaatgaggtttctggataccatgtgaatatccaaaagttaattgtaattttcaagagtaaacagttagaaagtggtatttttttaaaataatgccatcaataaatcaaaaataaataaatgtataaaatatgtttgagatacctaagcagaaacatatattatgaatgagaggatttaaagaaaacgtatctaaatggaaaactatgtcatgctcatgggttggcagaatcaacattataaagatgtaaactctcaaaaattgatctgtagagtcactgaaatcctaatcaaccccatcaggagtgtgcgtgtgtgtgtgtgcgcacattataaaaatttatgtggacatgcaaaggtccaacatagccacgacaatcttaaaaagaacaaagtgggaaattttatactaacagatattaccaattattatgaaacaattgaaattcaaacagtgtgtttttggtgtgaatacagataactagaacaatggaacataagagagagtctaaaaacaggctcacacatatatagttacctgatttacagcaaaggtgacactgaagttcagtagggaatgaatcgtcttttctataaattatgtgggatcaactggagattagattttagacttaaatgtgaaagctgtgaaagaaataattctagaagataacataagagaatagtttcatgaccttggtggggacattttttaaacaagatataaaatcaccagcttaaaaatattggcatattggcttcattaaagcaagaaattttactcatcagaaggcttcactaggagatcacagagtgggaaataatatgttaatgaaatgttatattaagcaagcaaattatactttaatatttatagtatctcattgaaaaaataaaactctatatgagtgtgtgttttgtttaaataagcaactacagaaaacatacatatgaacacacaaaagagacactatgagattataaaagtgaaggaatagtttatgagcctctgagctgcttaagcttctaaaggctgatagagtaggtaactagaaatgttgcttattatttcattctttaaaaacattttcaaaagttagtttgaagtctgcctggaaactgtctggtgaagatgatcaaggcaatgaaaaggaaactattaaaatctttaaaatcttccttattccaaatccacactgttgtattgtcatattggcttcattaaaacaagaaattttattcatcagaagacctcactaagagacagagagactgaaaaaggaaatcagagaatgggaaatgatatttgtgtatacgtttaaaaaaaaaaagctagtatccagaatatattttaaaaactcataacaatcaataaaaatctatttttaacaaaataagtgaaagattttaaaatatgttgcaccaaaaagatatcagaatgaccaataaaaatatgaaagaaccagatacagagcacttgcctgtagtcccatctactcaggaggctgacacaagagagtcacttgagcccaggagtttgtgtccagccaggataacctaggggagactttgtctcttaaaaaaaaaaatgaaaggatgtttaacattgtaaaagcatcaagtaattaatattaaaaccacaaagcaaaacaactacatacccattgtaatggccataatcaaaattaaaaaaaaaaaaaacagaactgaaaatactaagtattgttgtaagtgtgatgtgattggaaaacccttccacactgtttatggaagtgaaaattgaccctcctgctttgacaaactattggtagaatatactaaaacaaaaatgttgcattctgcatgacatataaattccacctttaagatagattaatcaaaagataggaacagtaaggttcagtgcagtgtttgtcataatagccacaattagaaacaacccttatatgccgcaacattaaaattaataaagatacatggctctattcaaataaatgaatgctatacagaaatagaaatgaatggactactgatacatgcaataccatgcgtggacttcacagacataatttgagtgaaagaaaccaaacatagaaggtgtgtattatgtaattatatttatgcaagggttaaaagtagagaaaacccaacctatgctaatagaaaaccaggtagaaccaatttatggtgttacacgataaaagtggttacctttagagggaagcaatgttcgggaccaggtaacaaaaatgcttgtgagattattaaaatgcctatatcttgatctgggtgatcgatatactcaatgttaattgtgtaaaaagtaatgaagctctgcatttatgattcatgtatttttatgtatgtatctttctgtgtcatattccgttttttaaaataagcatagattaaagttacatgtaaatatttttagatatatttgtggaatgctgtatgaaacaagcaaattatagtttgatatttatagtatttcagggaaaaaataaaaccctgtattatgtgagtgtatatattgtttaagcaactgtataaaaatgtgtatgaacacacaaaggggaaactatgacattataaaagtgaaggaagattttgtgagcttctgagcttcttaagcttctaaaggctgatagagtaggtagctagaaaggttgctcattattttattctattgaaaacattttcaaaagttagtttgaagtctgcctggaaactgtctgtgaagatgatcaagcaataatcatcttatagtcttccatattccaattctaaactgttgtatttatttcaacaaatataaaaatagatttcctaacattttcttattcaaaaatgttggggttagagaggttagaatacctctctttagatgagccatttacatctagatgactgcttaactggctcatacaaatttcagatattgttcccttaggatattgtccagagtaaaagaattccatggactcctgcagaatgttcagttactctacaccacagaatgcatttgcacctaaggagatatgagacattcaaataatatcatgtcaaagagtttttttcagattacctgctaaagccatttattattattttttaaattatactttaagttctgggatacatgtgcagaacgtgtaggtttgttacataggtatacatgtgccatggtggtttgctgcacccatcaacctgtcgtctacattaggtatttctcctaatgctatccctcccctagctcccccaccctctgacaggccctggtgtgtgatgttcccctccctgtgtccatgtgttctcattgttcaactcccacttatgagtgagaacatgcaatgtttggttttctcttcctgtgttagtttgctaagaataatggtttccagcttcatccatgtccctgcaaaggacatgaattcatccttttttatggctgcatagtattccatggtttatatgtgaagccgtttattttatgaactgtccaactagaatatgaacaatatagtataattaaccaaaactccgccaatttaattgtgaatggattattatatcttagaagttctcaaatatggcacatatgtattacactaaaaataagccttccacgaagtttcatgtagtttcctttagcagagaatgctgaactctattatagatgtatgttttatgtactgtcatcactttatatagaaatatccatcgattgcatgagagaactttcatgaatcaacatggctattagttttctcttaacagagatattttagaaaacacagttagaaatatgtgtattttagggatgcagagaaagcatttttccctaggagactggaaatttagtttatatttttagattcctgtcatgggttctgcaaatgtttctaagaaacattttctacacaatcaaggataatttgaatcacaacattttcttattcttccaaatgtatattttttagggatctctttgaaatttttgactactagaatgatctaaatttaagcatgcacttgccttctggtgtgtcctcagactgggtgagttctgggagaagagggaatgttgcctcagtaatgatgatctactaatgctagagctaaaacctatgtgttagacttttctgttaactatctaaaatgatcaatatcccttgcttctcaagatcagtttcgtagattgaatcttgtaaagaggttaatttttctcatcctcactgatcatcatgctaagtcccagaggtaaggaatggtaaagaaattatacctcttgatcgggtagtaccgaagttctggaagaatgtgtggaattgaagatgttcctgtcataatttttagaaatgcaatttgtcacatggtaaagaaaaaaatgatgctctgtatggttaagagaagatttgggcaacaacccagttgtatttggcaaaatgaatctgtgtgtagaagttgtttatttttacttttggcttctgtctgcgataaaaatgaatgatcagcatttctttctagacttggtccatatcaaatttatttcctatttatatagatcatcttaaagagaccactactgtctgcaattctaatttttggatttttatcttggcctgaaattttcactcagaaactagtatgcttcctccttctgttactcactaagctggcctttgacttgacattatggacttctggaaacagctgtgctataactgtatctcaaaaatgtttactcctcatcagttatttaatcaggaatggctatgcatttgataatttttggcaaatactgggtctccaaacgataatagttttagaactgctgatggtagtagctacttagtagtttattccagacttttaaaaaagaaaatgaaattcagaatgctctctaggtcacacagaaaattagtaacagatccataactggaagtagattctgagacaagaaattgaaggaacgtaatttatttgggaggcaatacctggtaatactttgctgcataacaagccacctcaaaatgcagtggcttaaaacaatgacagcctttattttgtttacaagtttgtaaatttaggcagcatttgacataaacagctgatctctgccccagatggtatcatagggagaggctcaaaggctgaggactagaattttctaaaaacgtattccctcctcactcatgtatttgtggttgatactagctgctagttgagacctttgctgggtttgtgatcagaacatttatacatggcctttctgcgttactgcttggcttcttcatagtaaagaggctggcgtccaagttgatagttagaaaatagaaagccaggaagaatctataacatcttttatgacctaactttgtaagtcatccaacgtcacttcagccacattaaaatcaggaagcccatcaccaaggcttcatacttgaagtcccatgtctctgcgctcatttcctactacccccttctctttctcagtttgctccagctatacccatgcctcataaaatattctatcctcaaagattatgtgtcttgtcttgcaaaaacctaaaccattcagaaacagacataaatgatttaccttactgaaataggggctaattttttccagtatctcattccaacctgatcgctttatgtgtatttgggcatatgtgtgcaatataaggatatttattcagcatctggtatatcctaggtgctggaaatacagcggtaagtagacagtctcgttctatggaacttccagtatttttggggaggtaggaaaacattgctcaaataatcacagagatataacctttcagatgtgtcaaggaaatatacatgttgctttagtgcctataatagcaacaattggcttctttggaagagggtagagagggcttatttgaggaagagatgattcatttgagatctataaataagacctaactcactgaaagattttttttgaagtcctgttagggtcaatggcctactcatgatcttcttgtaaatataaaatatatatatatttcaaacttaatatgttgaaaacatggctcaatctctcctacccatctccaccagatatggtcttccaaatgctgtcttcatcactgtgaatagcagcaccaatattccagttttgcaggacacaagacttaattattcttaacatcattcttaatatcattccttaatattcactttatttttcataccttaccttcaaatatatccagaacctgactatatcttcctacctccatagctgcttccctgattcaaaccatcatcatcactctgctgatatgttgcatacccttctatatgtttttcactggtttgtaacccattagtgagccataaaattaattaatttatgccttgtaaatagcagtaaaacaatgccttgcaatataatagaaaatattgaattgcataatgcatagatcaattttttgtaaaacgtatttcagttttatttataaatatataaacatgtagacatatatgtctagatgtatatgtacacatgtgtgtgtccatatatcctgaatctcaatataaaatactcttactgtgtatgaatttaaaatttttgaaaggtatttggattcttcctgcttcaacttgtagcctcactcgggagtactctgaaaacagtaatcagagggatttcctctacaggcaatacattttaattaattaattaaatatataaggcagataaagatacatctctattcaaaatacttaatggactcccatttcgttaaaaataaaagcctattgtaagtcattacaatggcctgtgagtcacatattcagcccataccttctccctttctctctaacctcatctcctgctaatctcacacttgctcatcaaacccagtcaaactggtcttctcgctgtttgtaaaacactccgagcacataccgacttcagaacttttgcacttactattttacctgcctaaagttacttccctttatgtaagttcatgtcgtcctccctcgcctctttcacgtttcttaccttctcattgagtcatccatagcctgcctattttaaatttctgtcatctatcttcaatgccctacagtccccatcatccttgcctattttatatttctccataacgcttgtaatctctgatgtaccatgcattttacttatctgattattttctgtttcccttgacccacattagactgtgagcttcatatggtaattagttttgtctatactgtaatctgcacaattcccaatgactagtacactcactattatgtagaaggtaatcaataagttgttgaatggatggagggaaggagaaaaggagggaggctggatcaatggatggattaaaaaaaacaaatgaaagaaatagaatttcaaggatcgggaatgagacgtaaaacagctctctaaggctgggtgcggtggctcatgccggtaatcccagaacattgggaggctgaggcgggcagatcacctgaggtcaggagttccagaccagtctggccaacatggggaaaccccatctctactaaaaatagaaaaactagtcaggcgtggtggtgcacccctgtaatcccagctacttgggagactgaggcaggagaatcgctggaaccagggaggcagaggttgcagtgagccaagattgcgccgctgcactccagcctgggtgacaagagcaagactccagctcaaaacaaaaacaaaaacaaaacaaacgaacaaaacactctctagctggagagtcaacagaggatggaggatgctttggtccatggccatgagaaagactgaaaagaggccagtgtagctggagaggaaggaatgaagtaaggattgggatggaggaatatatggctagagaggtattcaggagtaaaccaaaaagcaccaaaacacaaaactaagggaattactctatatcctaaaaatactgggaagcctttgaaggcttttaaatttgggaaagcggtggagggatcaagaacaatgggtgatgtcattatcttatttacattttaagtgatagggaaaaacgataattcataaacatggtttaggcctagtgagagaaactatatctctcatcagtttaatctgagttcataacattctctagatcctaaatggtcctagtcacatttctgagtcagttctttgcttagatgtataattcattgactcttttattattttattttatttttatttttatttttccattagttattggggtacaggtggtatttgattacatgagtaacttctttagtggtgatttatgagattttgatgcacccatcacccaagcagtatacactgcatgatatttatagtattttatccctcgccccctcctactctttcacccatgttcccaaagtccactgcatcatgcctttgcatccccatagcttagctcccacatatcagtgagaacatatgatgtttggttttctattcctgagttatttcacttagaatagtagtctccagtctcatccaggtcactgcaaatgccgttacttcattctttttatggctgcgtagtattccatcagatatataaatgcattatatcatatatatttaattcagattacataatatataatgtattataatatatatacaatgcagatgacatcacacacacacacatagatatatattaaatgcagatatatatatcacagtttctttatccactcattgattgatgggcaattgggttggttccacaattttgcaattgtgaattgtgttgctataaacatgcgtgtgcaagtatctttttcgaataatgacttcttttcctctgggtagatactcagtagtgggattgatggatcaaatggtagttctagttttagttctttaaggaatctccacactgttttctatagtgactgtacaagtttacattcaacccagcagtgtagaagtgttccctgttcacagcatccacaccgacatctactgttttttgattttttgattatggccattcttgcaggagtaaggtggtatcacattgtgcttttgatttgtatttccctgatcattagtgatattgagcgttttttcatctgtttatttgccatttgtctatcttcttttgagaactgtctattcatgtctttagcctactttttgatgggattgtttgttttttacttactgatttgcttgagttcgctgtagattctggatattcctcctttttcagatgtatagattgtgaagatcttctcccacactgtgggttttctgtttactctgctgactgttccttttgccattcaaaagctctttagtttagttaagtcccagctatttatctttgcctaagccaatatctagaagggttttttccaatgagttcttatgtgttaagtgagtatcctgaaggcagcagatagttccttggtgagttcttatccattctgcagttctgtatctcttaagtggagcacctaggccatttacattcagtgttagtatttaaatgtgaggtacctttgcgttcattgtgctctttgttgcctgtggactttgtgttgtttttttgttttgtttcttgcttttgctttttagcttatatttttgttttataggtcctgtgtaatttatgctttaaagaggttctgttttcatggtttccaggattcctttcaagatttagagatccttttagcagttcttgtagtggtggcttggtaatggtgaattctctcagcacttgtttgtctgaaaacgactgtatctttccttcatatatgatacttagtttctctggatacaaaattcttggctgataattgttttgtttgaggaggctgaagatagggccccaatccctcctagcttttagggtttctgctgagaaatttgctgttaatctgataggttttcctttatagtttacctggtgcttctgtctcacagctctcaagattctttcctttgtcttaactttggataacctgatgacaacgtgcctagatctttttgtgatgaatttctcagatgttctttgtgctgcttgtatttggatgtctaggtctccagctaggctggggaattttcctcaattattcccccaaatatgttttccaagcttttagaattctcttcttcctcaggaacactggttattcttaggtttggttgtttaatgtaatcccagacttcttggaggctttgttcatattttctttttcttttttctttgtctttattggattgggttaattcgaagaccttgtctttgagctctgaatttttctcttctacttgttcatttttattgctgagactttctggagcattttacatttctaaaagtgtatccaaagtttcctgaattttttattgtgttttctttaagctatctgttacattgaatatttctcccttcacttcttgtatcattttttggatttccttgcattgggcttcacctttctctggtccctccctaattagcttaataagtaacctcctgaattctttttcaggtaaatcagggatttcttcttggtttggatccattgctggtgtactagtgtgattttttttggggggggggagggtgttgaagagtcttgttttgtcatattaccaggttttctggttccttctcatttgggtaggctctgtcagagggaaggtctaaggccgaaggctgttgttcagattcttttgtccagtggggtgttgccttgatgtagtactctcctccttttcctatggatgtggcttcctgtgagccaaacggcagtgattgttgtctctcttctggttctaaccacccagcaagtctacccggctccagactggtactggcggttgtgacactctgttcgcatcagagttctgtgatgtgaaccgtctatgggtctctcagctgtggataccagtgcctgttccggtggaggtggcgaagagttcggtggattccctgagggtccttagctttggtggtttaatgttctactcttgtactggttggcctcctgccaggaggtggcgctttctagaaagcatcagctgtagtagtgtggagagggactggtagtgggcggggccctagaactcccaagattctataccttttgtcttccgctgccgcgtggatagggaaggaccatcaggttggggcagggcgaggcgtgtctgagctcagactttacttgggcgggtcttgctgcagctgctgtggagaatgggggtaagattcctaggtcactggaattgtgtacctaagatgattatggctacctctgctgagtcatgcaggttgtcagggaagtgggggaaagccagcagttacaggcctcagccagctcccacacaaaccgaagggcctgtctcacttctaacatgtccacggctccccaacagccctgagtatgtttacaggtggagggcgagaggggcttgaaacttgcctgaggctctccgcctcccagctgccaaagaaagggctttagttccctgccccccacccccgccccttccgccgcctgtgaagggacccaccgagctcccagggcctttctgctgcttcctctacccctgtattttgctcggctctgtaacttgactcagcttcaggtaaagtcagaaacttctgcaaacagaccttcaacttctcctgtaggggtatgtgttcgggagaggagggtctccctttcccacttttgtagctggggcactcacagtatttagggtgtttcccaggtcctgcagtagtccgcttccttcagagggtctgtgagtcctctcaggattgctgatttgttcttttagttgatctggcgctaaaattcacagtgcaagtctccagatgctgttctatctggagctgcaatgtagtcctgcctcccatccgccataatcccctccatctcctaattccttgacatgtgagaaacccttcaaatttatgcttctggaaaccctgagaatataaagatcatggcattattccaagaagagatgtcggtttatttaatgtactttattaagcaagatgcaagtcagatgttatgattttcagttacaagtttttcctatatctataatttgaagattatagtatactgaaagcattagctttgggctcaattataaatgtattatccaaagaacttgctgtattatccaaatttaaatataaaatagtctttcaataacgattgagttctaaaagtaaaaataaaaggaaagaaataattatactttagacaaaaaaccgtactcaatttaacacataccagacacacacacacacacacacacagacacacacacactccacacacacaattagcctggtgggctataagtagagtgaatgaaaaataagctacattgttttatttttattgtgttaatgcagtaatgaagttaaaataaatgcgatgtcttcttttgaaaggtatctgttcatgtaatttgccctctttttaatgaggttgtctttttcttgtgaatttgcttaagttccttatagattctggatattagacctttgtcagatgcataatttgcaaaagttttctcccattctgtaggttgtctgctcactctcttgatagtttcctttgctatgcagaagctcagtttaattagatcccatttgtcaatttgtggttttgttgcagttgcctttggtgtcttcttcatgaaatatttgcctatgcctatgtcctgaaagatattgcctaggttgtcttccaggcttctatagttttgggttttacatttaagtctttaatctatcttgagttaatttttgtatatggtgtaaaaaggggtccagtttcaatcttgtgtatatggctagccagtaccattaattgaaagggaatcctttccccattgcttgtttttgtcaggtttgtcggagatcgtatatgtgtaagtgtgtggccttatttctgagttctctatcctgttccattggtctatgtgtctgtttttgtattagtactatgctgttttggttactgtagccctacagtatagtttgcagtcaggtagcatgatgctcaacaccagtgatcattagagaaatgcaaatcaaaaccacaatgagatgccattgtacaccagtcagaatggctattattaaaaggtcaaaaaataacagattctggcaaggttgtggagaaaaaggaatgcttatacactgttggtgggagtgtaaattaatttaaccattgtggaagacagtgtagcagttcctcaaagacctaaaaatagatataccattcgatccagctatcccattatgggatatatatacctaaaagattacaaattattctattataaagacacatgtatgtatatgttcattgcagaattattcacaataacaaagacatgaaatcaacctaaatgcccatcaatgttagactagaaaaagaaaatgcggtacatgtacaacacggaataccatgcagctgtaaaaaagaatgagatactgtcctttgcagggacatggatgaagttggaggccattgtcctcaccaaactaacacagaaacaaaaaaaaacaaacattgcatgttctcacttataagtaggagctaaatgataagaacacatgggcacacaaagggcaacaacacactctggggcctttctcagggtggagggtgggaagagggagaggatcagggaaaacaactaatgggtactgggcttaataccagggtgatgaaataatctgtatgacaaactcccatgtcacaagtttaactatataacaaaccttcacatgtacccctgaacttaaaagttaaaaaaataataaaaaattaaaattaaaatgaatgggataatattgtaattcagaaaattgctactaatcaaaatgggaaatcaatgaatgattgatatgttttttcataaaggactaattataatactatgctttgggattttgcaagatactataatgaactcatagataccttcaagtgtttctgactatcacctaccataggaaatacattttatttgtacttacacatacaacacacaaacttacacacatatgtgaaaaatgaattaaagtctcctgaagcaatgatcacccttttctttgttgggcatgctagtatttcctcttctattatgtcttatcttattctatctcatttttataaatactgactatatactactaaattgattttatcatcaactaatgcgttataacacataatttgtaaaaacaacttatatacagtaatggttgctttctgcagaggagtagtagaaaaatttttattaacttcttcacacatcaaatattgagataaaaataagaaaacacctagttgattgatttttccaatgtgcaaatattcaggcagttatttatattatttatattgatatcatttatgcaacttgtaaatctgtgcttaactgttgttcaaatagcctcatggtaagggtcattcacattgtgctgcaaggaaattttgaaggactttattttcaaattgttatttggatatatgtgaatcaagatgtaataactatcttggctccagaagttctttaaatttttatccccatgtgaaaatgtgtatttatcgctctattagggacaattaatcagggaaatctcaaatattaattccaaacatgcaccatcagtgggctgaataactgtgcatatgaataatgtatatgtccttctgtgtatctatggttactgcaatttcctcttacgttgtaatttgtaaaagttatacaagaggagtttaaaaatagtagagtgtaaatgtgactggcgagaggagttggtaacaatagacaacaacccagaagaatattaactaatctacctcaataggacctactgtaccttacttgtgaatacctgaatccatccccagtaggtctaggtggatcaaagggaccatagagaacaaaaccaacaattgcaaaagatctcacataaacggactactaaaatcacttgtcttaaaccatgggtgttaaaaaaaatctatattttctgattcattaaaagcacattttagaccacatatgtaacctaaaccctattattttttagataacagcaaagagttaatatctctactttccagcatgtgaaattctgctgtaaagctttatggtattcttttcttaaacctttttcagtagaagataaaaaaactgccatttcaaagctgcaacaagtttttccagtcacaagaattgaagcctcattgttctattgttttgggaaataaaatgaacatttgaaaaaatcttttaatttcataaatgtgagatccacaccctcctcagaaatagggagatttcagatgctgtggtttttccaaggttgtataggcagggatcatgtttccttttgagaaatgattattggctctatatggatttaaagtttgctttatgtgaaatggtggttatactcatggcattcttttttttttttttttttttttttgagaaggaatcttgctccgtcgcccaggcgggatggagtgcagtggcgcgaacttggctcattgcaagctctgcctcccaggttcacgccattctcctgcctcagcctcctgagtagctgggactacaggtgcccgccaccacactggctaatttttttttttttttttgtatttttagtagagacagggtttcaccatgtcagcaggatggtcttgatcttctgacctcgtgatccgcccacctcggcctcccaaagtgctggcgtgattacaggtgtgagccactgcgcctggccactcatggcattctatgtagctttatctgatctatttatttggggaagacaaggagatgagaagggatttgattgcagttttggttactgtagccttgtagtatagtttgaattcaggtaatgtgatgcttccagctttgttctttatgcttaggattgccttggctattcaggctcttttttcggttgcatatgaaatttcaaatagtatttttaataatttggtgaagaatgtcattggtagttttataagaatagcattaaatctgtacattgctttgggtggtatggacattttaacaatattgattcttcctatctatgaccatgtaatgtttctccatttgtttgtgtcacttccgatttctttgagcagtgttttgtgattctctgtgtggagattttcacctccatgattagctgtatttctaggtattttattcttttgtggctattgtgaatgggattgcattcttgatttggctttcaggttgggtgttcttgatgtataggaatgctactgatttttgtacattgattttatatcatgaaaatttctaaagttgtttatcagatcaagcagcttgtgggcagagactatggtgttttctacatatagaatcatgtcatctacagagatattttgacttctcatcctcctatgtgaataccttttatttttttctcttgcctaattgctctggctaggacttccaagagagagggcatccttgtgagggatggcatctttgtcttctgctggttttcaaggggaatacttgcagcttttgaccattcaatgtgatattggctgtggatttttcatagattgatcttgttactttgaggtatgttccttcagtgcctagtttgttgaaggtttttaacatgaaaagatgttgaattttttcaaaagccttttctgtgtttattgagatgatcatacagggtttttgtttgtttgtttgctttttagttcactttatatggtttgtcacatttattgatttgcatatgctgaaccttcattgcatcccagggataaagcttacttgtacttcgtggattagctttttaatatgctgctggattcgctttgccagtattttgttgaggatttttgcatcgatgttcatcaaggatattggcctgaagtttctttctttgttgtgcctctgccaggttttggaatcaggatgatgctagcctcacagaaagatttggggaggactccctcttatttttcggaatagtgtcagtaggaatggtaccagctttaccttatacatctcgtagaatttgacgacaaatttttctggttctgggccttttctggttggtaggctttttatgactgattctttttaagaaatcatagttgatctgttctgggattcaatctcttcctggttcattcttgggagtttgcgtatttccagaggtttatcagtttcttctaggttttctagcttgtgtgcatagagatgtttgcagtagtctctaaggctttcttatatttctgttgggttggtgttaatgttcgctttgtcatttctgattttgtttatttggatcttctctctatttttctttattaggctagctaatggtctattttattagttctttcaagtaaccagctactgaattcatttatcttttatatggttttttactagttcagttctgattttggttatttcttgtcttatgctagccttgggattgttttgctcttgtttctgtagtttttctaattgtgcttttaaattgttgatttgagatctttctaagttttagatgtgggtgtttagtgctataaacttccctcttaacactgctttggctgtgtcccagagattctggtatgttgtatcttttttctcattagtttcaaataatttctggatttctgccttaatttaattatttatcgggaagtcataaatattgggagcaaattgtctaatttccatgtcattatatggttttgagtgattttcttagcattaatttctatttttattgcattgtggtctgagagcattgttggtatgattttggatttttcacatttgctgaggatcattttatgcctgattggttgattttagagtatatgtcatgtgcagataacaatgtatattctgtttttttataggtggagagttctgtacatgtctattaggtccatttgttcaagtgctgagttaaggcttcaaacatctttgctagttttctgtgtcagtgatctgtctaatattgtcagtggggtattaaaatctcccacttatattgtttggttatctaagcctcttcacagatctctaagaacttgctttatgaatctgtgttctcctatgttgggtgcctatatatttagtatagttatgttgtcatgttgaattcaaccctttaccattatgtagtacccttctttgtcttttttgatctttgttgatttaaagtctgtttttttgtgtgtgaaattagaatagcaacccctgcctttttatgtatttggtttgtttggtagatttttcttcatccccttactttgagactatgagtgtcattgcatgtgtgatggatctcttaacgacagcataccattggttttgcttctttattcaacttaccactctgtgtcttttaattggggcatttaacccatttacattcaaggttaatatggatatttgcaaatttgatcctgtcatgttgttaactggttacttgttattaacaaacagaattgtttgtttggctgctttatattatcactgatctatgtacttaagtgtgttttatggtggctgataatgatctttccatatttagcactccctatagttcttaactccagtcaccctagtctgctataacatgaggatgcatgtatcatgttgacatactgatttccttttctttggagagacagccagtagtgggattgctggatcatgcagtaattcttttttttttcttctagaaatctgtatactgttttccacagtagacatattcatttacattcccatcaacagtgcacaagagttcccttttgtactcatcatatccagcatcatttttttttcttcttttaaaacttgtttctcaggttcaagagtacatttgcaagtttgttaaataggtaattgcatgccacaggggtttggtttatagattattttgtctgtcaggtattaagcatagtaccagtggtagtttttttatcctgaccctctcccaccctccatcctcaagtaggccctggtgtctgttgttgccttttttgtgttcatatgtactcaatgtttgtttgtttatgatttaggatctcactgtcagccaggctggagtgcagtagagcaatcacagtttactgcagcctcgacttcttcaggctcaggtgatcctcccacctcagcctcctggatagctgggactacagatatgcataaccatgcctggctaatttttcagtatttttttttgcagagacagagttttgctatgttgcccagactggtctcatctcctgggctcaaccaatccaacttgcttagcctgatcctctccctccctcctcccaccctccaccctctgaaaggccccagagtatgttgttcccctctatgtgtccatgtgttctcatcagttaatttctatttataagtgagaagatgcagtatttggttttctgttcctgcattagtttgctgagagtaatggcctccagctccattcatgtccctgcaaagaacatcatctcattctatttttatggcttcacagaattccatcatgtatatgtaccacatttcctttatctagtctatcattgatggccatttgggttgatgccatgtctttgctattgtgaatagtgctgcaatgaacatgtgtgtatgtgtctttttaacagaaggatttatattcctttgggtatatacccagcaatgggaatgctgggtcaaatagtatttctgtgtttaggtctttgaggaatcaccacactgctttctacaatgactgacttaatttatactcctaccaacagtgtatatgcattcctttttctacacaacctcatcagcatctcttattttttgactatttaataatagccattctgactggggttaaatggtatctcattgtgattttggtttgcattttttttttagtgataagtgatgttgagcttttttcatgtttgttggctgcatgtatgtcttctttgataagtgtctttttacgtcatttgtccactttttattgcagttgttgttttgtaaatttgttccttataaatgttggatattagacctttgtcagatgcatagtttgcaaaaattttctcctattctgtggattgtttactttgttgatactttcttttgctgtgcagaagcttagtttagttttattccatttgtcaatttttacttttgttgcaattgcttttggcgtcttcatcatgaaatctttacctgtgcctatgtcctgaatggtattgcctagattgccttctaggatttttatagtgttgggttttacatttaagtatttaatccatcttgagttaaattttgtacgtggtataaggaaggggttcagtttcaatcttgtgcatatggctagcctgttatcccagcaccatgtattgaatagggaatcctttcctcattgcttgtttttgttaggtttgctgaagatcagatagttgaaggtgtgtggtcttatttctatgttctctattctgttccattggtcagtgtatcttttcttgtaacagtaccatgctattttggttactgcagacctgtagtattgtttgaagttgggtactgtgatgcctccagctttgttctttttgtgtaggattttttggctacatggactctgttttggttccatatgtattttagagtagtttttttctagttctgtgaagaaagtcacctgtagtttaatgagaacactattgaatctataaattcttttgggcagtatggccattttaacgatattgattctttccacttatgagcatggaattattttccatttgtttgtgtcatctctgatttctttgagtactagtttgtagttctccttgtagagatctttcacctccctagttatctgtattcctaggtattttattctttttgtggcaattgcgaatgagagtttgcttatggtttggctctccgcttgactgttgttggcatatagaagtgtgagtaatttttacacattgagtttgtatcctgagatttttctgaagttgtttatcagcttaagaagcttttgggctgagatgatggggtattctagatatagggtcatgtcatctgcaaacagggatagtttgatttattctcttcctatttggataccctttatttctttctcttgcctgattgccctggccaaaacttctaatactttattgaatagacatgatgagataggctatccttctcttgtgctgcttttcaaggggaatgcttccaggttttgcccattcattatgatgttggctatgggtttgtcatatatggctcttattatttggaagtatgttccttcaatacctagtatattgagcatttttaaaatgaaggaatgtttaattttatcaaacaccttttctacatttattgaaataatcatgtggtttttgtctttagttccatttatgtgatgaatcacatttattgatttgcgtatgttgaaccaaccttgcataccagggatgaagcctatttgatcatggcaaatacactttttgttgtgctgctggattcagtttaccatcattttattgaggatttttgctttgatgttcatgaaggatattgacctgaagtttttgttgttgttgttgcatctctgccaggttttggtatcataataatgctggcttcatagaatgatatagggaggagtccttcctcctcagtttttttttttttttttaatagtttcagtagaaatggtaccagttcttcttttacatctggtagaattcagctgtgaatccatctggtcctgggctttttttggttgataggctatttattgccgcttcaatttcagaactctttattggtctgtcagggattcagtttctttctggttcagccatgggagggtgtatgtgtctcagaattcatctatttctgctagattttctagtttaatatatcatattttcttcattattctcatgatgaacatttagggtgatttcatgtctttgctattgtgagtgctgctgcaatgaacaaaagcatgcatgtgtctttatggtagagttatttatatttctttggatatacccaataatgggatttctgggtcaaatggtaattctgtttttaaattctttgagaaatctccaaagagccttccacaggggcttaactaatttacattcccaccagcagtgtgcagacatttctttttttctgcaaccttcctagcatctggtattttttgactttttaataatagctattacgactggtgtgtgatagtatcggattttggttttaatttgcatttatttaatgattagtgatgttgaagcatttttttcatatgcttgttggccacgtttatgtcttcttttgagaagtgtctattcatgtctttgcccattttttaatggcagtgttttttgcttgttgatttgtttatgttccttagagattctggatattaaacctttgccagatgcatactttttaaatattttctcccattctgtaggttgcctgattactgtgttgatagatggttttgatgtgcagaaggtctttagtttaattaggtctaatttgttcctttttattctattgcagttgcttttggcatcatcatcatgaaatctttcccaaggcctatgtccagaatggcattttctaggttatcttctagggatttttatagttttaagttttacatgtaagtctttaatccatttttagttgatttttgtatatggcataagcaaagagtccggttaaaatcttctgcatataactaaccagttatcccagcaccatttattaaatagaaagtcctttctgtattgcttgtttttgtagattttgttgaagagcggcttcttgtgggtgtccagcattattttttggcactctattctcttccattggataggaagaatcagtatgttaaaatggccatattgcaaaaacctatttgcatattcaatgctatcagtctaccaataatattcttcacacaattagaaaaaatgactatattaaaataaatatggaacccaaaaagaggccaaatctccaaggcaaaaagagcaaaactgatatgcagaaaattgaaagtgaatccatttcttacactttatacaaaaactaactcaagctgaaaaaaaaacttaagtgcaaaacccaaaactataaaaaccctagaagaaaatctaggcattaccattcaggacataggcatgggcaaagatttcatgacaaaaacatcaaaagcaattacaacaaaagcaaaaattgacaaacagaatctaattaaactaaagagcttctgcacagtaaaagaaactgtcatcagagtgaacacagagccaacagaatgggagaaaatttttgcaacctatccatctgacaaatgtctaatatccagagcctacaaggaacttaaacaaatttgcaagaaaaaaaaaaaaaccctaaaaagtgagcaaagaacatgaacaggaacttatcaaaagaagacatttatgttgccaacaaacatatgatcattagagaaatgcaaattaaaaccacaatgagataccatctcatgccagtcagaatggcgattattaaaaagtcaagaaacaacagatattggtgaggctgcagagagataggaatgcttttacactgctattgggaatgtaaattagttcaaccattgtggaagacagtgtggtgattcctcaaagacctagaaccagaaattccatttgacccagcaattccattaaagggtatatacccaaaggaatataaataattctattataaagatacatgcacatgtatgttctttgcagcactgttcacaatagcaaagacatggaatcaacccaaatggccatcaatgacagactggataaagaaaatgtggtacaaatccaccatggaatactacacagccataaaaaggaatgagatcctgtcctttgcagggacatagatggagctggaagctattatccttagcaaactaacacaggagcagaaaaccaaacaccacatgttgtcgctcataagtgggagctgaacaatgagaacacatggacacaaggaggagaacaacacatgcgggcctgttggaggggtgtggcaggggaggaagagcatcaggaaaaatagctaatgtatgctgggcttaatacttaggtgatgggttgataggtgcagcagactaccatggcacaggtttatctatgtaacaagcctgcacatgtaccttggaacataaaataaagaataaatactcagaaaaaaattcaaagctgaaggtatcacattacctgacttcaaactataccacaagactacagtaaccaaaacatcatcgtgttgatattctttgtagtagccattttagcttgggtaagatgatacctgcatgtggttttgatattcatttcccttatgattagtgataatgagcatttttttttttgatacggagtctcgctctgttgcccaggctggagtgcagtggcacaatctcggctccctgcaacctctgcctcttgggttcaagcaattcttctgcctcagcctcctgagtagctgtggctacaggtgcacgccaccacacccagctaatttttgtatttttagtagagacagggtttcaccatattgaccaagctggttgtgtactcctgacctcgtgatccacccgcctcggcctcccaaagtgctgggattacaggcgtgagccaccgcgcccagccgagcatttttaaatatataattgttggccatctgtatgtcttctttgccaattgctttttcatgtcttctgcccactttttattttttttattattattttctgagatgaagtctcactctgtggcctaggctggagtgcagtggcatgatcttggctcactgcaacccctatctcctgggttcaagatattctcctgcctcagcctcccaagtacctgggattacaggtgcacaccaccatgttcagctaatttttttttcttttttttttttgtagagacagggtttcactatgttggccaggctgggcttgaactgctgacctcaggtgatccacctgccttggccacccaaagtgctgggattacaggtgtgagccaccactcccggccctgcgcaccctttaatggaatgattggtttatttatttgttgagttgtttgagttccttgtatattccagatattagtgtcttaatagtttgatgaatagtttgcaaatatttcttccattctgtcttaatagtttggatgaatagtttgcaaatattttcttccattctgtaggttgtttcttcactctctgcattgttttctttgctgtgctgaagtgttttactttagtataatactatttgtctattaaggtcttagccagcaaatctttgcctagaccaatgtcctgaagtattttatgtatgtttccttctggtaatttaatagttttggttcttaagtttaataatttatcttgagttgatttttgtttataatgtcagagagttccagtttcattcttctgcatatggatatctaattttcccagcatcatttattgaggagcgtattctttccccagtgggaaaggaaatctttggcacctttgtctaaaatcagctggctgtaagttggtggatttgtttctgggttctgtattcactttcattgttctatgtgtctatttttataccaataccgtgatgttttggttactataggcttgtaatctatttttacatcaggtagtgtgatgcctccagcttatgttctttttgctgaagattgctttgcctacacagacattttttttagtttcttatgaattttagggcttaaaaattgtttaaatgatgacatttttaataggaattgtattaaatctgtatgttgctttgggcagtataattattgtaatgaaattaatttttccgatctatgagcgagatgagtctttacatttatttttgtccttgtcaatttctttcatcagcatttttcagttttgcttttagagagctttctccttcttagttaaatttattcctaggtgttttattctgtgtgtcactattataaagggaactgtcatcttgatttcttttttggctatttattattacattatagaaacacttgtgatttttgtatgttgattttgtattctacaactctactgaatttgcttatcagctcagagatttttggtgcagtcttttgatttttccaaatatataagatcatgtcatctacaaagatgaacaatttgcattcctcatttacaatttgggtctcttttatttttcttgcttgtttgcactggatgggacctctactaccatgccaaataggagcagttaaagttggcatccttctgtagctccagttcttaaagaaaagactttcacatttttcctattcagtgtgttgttgactgtgtgtttgtcacatatggacaaatgaattgaagatataatccttttatgcttagtgtgttgagagtttttgtcaacaagggatattgaattttcccaaaggctttttctgtgtcgattgaaatgatcatatagtttttgtccttcattctcttgatattatgtattatgttccttgatgtgtagatgttaaaccatctttacatccctgatataaatactacttgatcatagtgtattatgtttttgaagtgctgtttaattcagtttgctagaattttgttgaggatttttgcatcggtgttcatcatggatattgccctgtagttttctactttgtgtgtgtccgtatctggttttagtatcggggtaatgctggcctcataaaatgagatagggagagtttctccctctttcattttttggaataattttaggaagattcatattaattttcatgcatttgatagaaatcagcagtggagccacccactcctgggctttttttttttttttttaatggaaggctttttattactgcttcaatctcattactaattgttggtctattaaggttttctatttcttccgtattcaattctgataggttgtatgtttttaggaatttatctgtttcctctgggttttccagtttgttaatatatagttgtccctaatagtctctggtaatcttttttgtggtattagtggtaaaatgtctcatttttcagttcagattttggttatttagatcttttcttgtctttgttagtctagttagtgatttattttctttattttttgaaaaattaactttccctttcattcattctttttttgtttttagtctctattttgtccagtcctgttctgatatttattatttcttttcttctcgtaaattgggatttggtttgttcttgcttttctagttcctggagatgtattattagattatttatttcaaatctttttactttctgatgtaggtttttattattataaactttgctctaagtactttttttcctgtaatccacaggttttagtatgttgtttttccattttcatttgtttcaagaactatttttatttttgtcttaattttttctttgacctattggtcattcaggagcatgctgtttaatttgtatgtatttgtatttaatttgtattgtatgtatttgtatgtaaattgtatacaaatttgtatgtaaattgtacacaaatttgtaattgtatttgtacacaaatttgtaattgtatacaatttgtacacaattgtatacaaattatacacaaatttgtaattgtatacaaatttgtatgtaaattgtatacaaatttgtaaaacattcctctgcttttttgtttctacttttatttcttcgttatctgagaaggtactgaattggaaacatttttgagtctttatttgtggcctaacatagagtttatcctggagaatgttgcatgggctgtagaagaaagtgtattctatagtcattgggtttaatgttctgtaagtgctttgtaggtccgtttggtctaaagcctagttcaaatctcatttttcttgttgattttctgtgtagattatctgtctcctgccaagattgtggtgttgaagtcccccacaattattgcattgaaatctatctctcgctaaagatgtaatatttgaattatgaatctgggtgccctattattgggtaatgtatcctgttgcaggattaatactttttgtgggtagatgctatgtatgtatatatagtattggggtatctgggatattttcatacaggcaatactgcataataatcacatcctagtaaaaggggcatccatcacttcaattatttatcccttctttctgttacaaacaatccaataatactcttttagttactttaaattgtacaataaatgattggcaactgtagttactctgttgtgcaatcaaatactagttcttattcattctgtcaaactatatttttttaatacatgaacaatctctacttccctctactcacattaccctgcccaaactcataaccatcattttacctgtatctccatgggttcaattgttttaattttaactcctataaatgagtgaaaacatgttttgtttgcctttttgagcctggcttatttcatgtaacataatgtcctccagttgcatacatgttgttgcaaatgacaggttctcaatcgttttttatggctgaatagtactccattgtgtatatgtacacatatgttctttattcattaatctgttgatggtctcaggttgctttcaaatcctgcctatagtgaatagtgctacaataactagtgctgcaataaatgtgggagtgcagatatgtctttatatactgatttcctttcttttgaatatatacctagcagtgggattgctggatcatatggtggttctgttttaagtttttgagaaacctccaaactggtccataatggttgtactaatttacattcttaccaacagagtacaagggttcccttttctccacatactcaccagcatttgttattgcctgtcttttggatataagccattttaactaaagtgagataatatcccattgtagttttgatttgcattatctgatgaccagtgatgttatcacctgttctgatacctgtttaccatctgaacgtcatgttttgaaaaatatctattcatatcttttgcccattttaaaatcacattattagatattttctatacaattgttcatgctccttgtatattctggttattaatctcttctcagatgaattgtttgcaaatattttctcccattctgtgcgttgtctcttcactttgttaattgcttcctttgctgtgcagaagccttttaagttgatgtgatcttatttatatatttttgctttggttgcctgtggtttttgggtattactcaatgaatctttccccagaccaatttcatggagactttatccaacattttctttagtagtttcataatttgaggccttagatttaagtttttaatcaatttttatttgatttttatatagagagaaagatagtgggctagttctgttcttctgcatatgggtatccagttttccaagtaccatttattgaagactgtcctttccccaatatatgtcttaccacctttgtcgaaaatgagttcactatgtatgtatgtttttatttatgggatctaaattttgttccattggtctatgtgtctgtttttgtggctgtaccatgctattttgtttactatgcctctatagtataatttaaatcaggtaatgtgatttttctagttttgttctttttttctctggatagctttggctattctgggtcttttgtggtttcatgtaagttttaaaattgtttctttggccaggcacggtggcttatgcctgtaatcccagcactttgggaggctgaggcgggcggatcacaaggtcaagagattgagaccatcctgaccaacatggtgaaaccccgtctctactaaaaatacaaatattagctgggcgtagtcgcacacctgtagtcccagatacttgggaggctgaggcaggagaatcacttgaacccaggaggcagaggttgcagtgagctgagatcgtgccactgcactccagcctgggcaacagagtgagcctccgtctcgccgtctcaaaaaaaaaaaaaaaatagattttttttttttctatttttgtgaagaacatcgctggtattttttttttctttctttctttggagatggaatctcactctgtcaccaggctggagtgcagtggcgcactcttggctcactgcaacctccatccctcaggtttaagcattctcctgcctcagcctcctgtgtagctggaattacaggcacctgccaccatacctggctaatttttgtatttttaatagagacggagttttgccacgttggccagactggtctcaaactcctgacctcaggtgatccacctgcctcagcctcccaaagtgctgagattacaggtgtgtggcaccacacccggtattttgatagggattgcattgaatctgtacattgctttgggtagtatgtacattttaacgatactgtattttctaatttgtgaaaatggaatatctttatatttctttgtgtcttctttgatttcttgaatcagtgttttatagttttcattatagaagtatttctttcctttcattaagtttattcctagatattttattttatttgtagctattgtaaatgggattactttttatttcttcttcagatcatttgctgttgtcatatagtactgtctttttaaaaaaatgtttttggcttaaagtctatttcttctgacataattatagctacttctgctcacatttggtttctatttgcatggaagatctttttccatccctttactttcggtctatatatgcctttacgtgtaaagtgtatttttttatgcgtactatgtagttggttgatgtttttgtgttttttaatacatttttggaactaatcaacaaggctatttgttttaagtagatactttaatccatttacagccaagtttattatgataggtgaagttttgttcctgtaacaatgttaattgttttctgattattttatctattttttgttcctttctttctctcttattgatattgttgtagtttggtggttttatgtactggtactgactgagtccttctcttccttatgtatgtttgatttactaatcagttttatattttcatgtgttctcattatagtaaatgtcttcctttcctttccatgtttaggactccctttagcatttcttgtaggtccaccctagtggtgatcaactccctcaacttttcttgtctgggaaagattttatttctctttcatttataaaggataattttgctggatttaatatccttggctaacaattgttttctttcagtgctttgaatatatcatctaattctttcttggctataaggtttctgctgagaaatctgctgttagtctgatgaggggtacatatataggtacagatgtctagatgccttactcttcatgtttttagaatattgtctttgtctttgacttcagtttgactgtaatgtgctatgcagaatacctttttgcgttgtatgtttgagaatctcagatgctcctgtatctggatttctaaatctctcactaaccttgggatgttttcatctgttattttgttaaacatttattttaactcttttgctctctctttgcctcataggccaccaataatttgtatatttgatcacttaatggtatcctttatgatatgaaggcttcgcttattttttttattattttacattaatttttatctaactggattatttcagaacatctctgtaagttataagattcttctgctttatttagtctattgttgaagctgtgtaatatagtttatttttcattcaatgaattcttcagttctagaatatctgtttggttctttttttttttttagaaagctacctctttggtaagctattcatatctccttcatatcctatattatttttatgattctttgtgttgtctctcagaattctcttgcatctcattgagcctatttagaatcaataattgaattattttccagaatttcataaatttctttttgattggtaaatgttactaaataataattgttttcctttggaagtgttattttatttgctttttcatgtttcatatattcttaggttgatgtctgtgcatctggtgtaacagtccctttttctaattttttatatttgcttttgtagggagaaacattctcctgaagatatatctattatgttggctgggtaaggcaatttggttttgattctgagtatatgtaatagcatgtattttctttatgatttcttcagctgtgaacagtatcagtggtatctgttatttccttggtggcttagagtacagttattcatggaggctgtggataagcttccctggggctgtgacaccaggtaagccagtctttgggccatttggggcccaaggtgccatacactggcaccattgctagcagatccaggtggatcagcctctaggtggcttacttggatgctgatactggcagtaatgacctaggtaggtgtgaagattctcaggcccctgtgcagctggcatgacatggaaaatggcagtggcagttgtggagtgatcctctgggtgccaaacagtgtgtgctcatgttagcagttgttgcagtgggttgggtggactactgcccagacctgcaggtagtacatgcaggtagctgccagttaaggtgttaatagctgggtaggtaagtcttatcttaggcccccagaggagtgtttcagtgtcaatggtggtaggctgggatgggcagtcctctggcccctggattctgtgccctgaccaagagtagggatgaagctgggtcagccaggcttgtcctcatgcccctcatcaggggtgtgtgcgggcaccagccatgataggcagggtcagggcaatgccactgatggaattctcatgtggggggcagcagtagccacatttctgccctgctgctgggcaaggcgatgctgccagaaggtagaaagcatgtgccgctcacagctcagccctggccctgctcatgccttacactttgctgcagtacattgcctgttttgtgcctcagccccaagtgcagtagcccacacctcaatcacacctcagcacttgttgtggtatcctatacttcacttcacacctcagccctgggagcaccagcccacacttctcttgtgcctcagccccagtgcctctgggctcctggatagcgtgcaatatgttggggatggggctctaaaatcgagcctttctgtacctgtttatgactcagggaatgcgtgggacccagcattagctctatctctggaacagtaccatcgcacgatcttctggcaactccctatgttagtttcagggcccacgagggtcgaggggctctcttagggttaggattgtaggcagccagaagagaatgtaggctactgatagtctctcacttcccctttccctgttttgaggagtctctcttcacttctagccagtcccaacagagtagactgcctcactacttcttccttccttgctttaggtatttcttgtcacctctctgttgaattctagagttctgtcttgaatgagctatgcaaaatgtgattatctgctcactatttcatttattcttagtggaggaggtgagtacaaaatgcctctagtcagctatcttgatgtactctctcagattagatattaaatgtcctctcgaaggtgataccaacagtggaaatttatcattagtacatttttccaaaaaacttaacatactttaacatcatgaagtatttattaaactgctgtatatacatggcacagtgctctgaaatgttttgccctggggattttgacactagagattattatttccacgtaaagatgacaagatttagcaaaaaagtaaagtgagttgaagattcccaattcagtggcaaagctgaaactagaagctacctcacatttatatattatttacatattttaattatgggtttatattttaataattgtgagactgtattttacataaagttatcaatattctaagcttttatgtataatattcacaatatgtaaatcataataatataacagtatttacactcaatatttagagtatttaaaatgataatatacaactatttattaaaactaattttactagggaaaatattcatgtggtcagaagtaagttttgatgaattattatcatatacagattaaaattaaaattagtttattttgttttttatgatactctgacttcttactaacatttgagtgggaatgtgattggcaaatcttaccactgacctctcacctatataagagttcctcacagctaaatgttcaagaatgatggttttgataatgatggttgtgctaataaatacaacggcaaagttttaaaatgtactaccttattaaaagcaaccccataatttctaatatagcacttctctggtaatctgcatgagaatgtatttcttggacttagaaacgttagtaaggcttcctgccatttaacactcccccagaccactccatacccctaacatggcccaggtcagtttattggttaaggatataggacagattggcacacagaaaatgtaaagttcaggagatagttcagaaagttcagaactcagtggcaaattatttaacttttgtacatttctgaccacctagttttatctacttttaataagcctaatctcttgaagcatcaagtgacaaagactgctcctaatctaagtcaatttacagaagccatctgtaatggtttttaaacatgaccacaaattatttagtaccaattttagtgagaaattggatgtatgcataccctcatgttaaatctaggttgatttgcaaagcttcatccgtgtagtatttaaaaagtgatgctatattacttctgaagctagcttgtaaaaggccatacagctttgttcttatttactggagcactttctctaggagcctggagccaccatatgggaagtctgaatacccagacattgtcttgctgggtaggccatatctatgtgttccagctgacagaattgagaatccactgagcccagctttctagtcatctgtgtcaaggcaatagatacatgaatgaagccatttcagtagaccagtttttctatcagctaaatactatttagagacttgtgtagacaccattggttctgtttgaatttctgacacactaacttatgagattaaaaaatgattgttttaatacaccaagttttggtgtggtttgttatgttacaatagataatttaaacaccatgacttcaggaaaataagctttgcctctcccatcattcattaagttttatattcatgtatatatacgacagatatttatgaatgtcttcaatgtgctatatctgtttggggccgtaagaatataatggtaaataaaacactaaccttcctattttcatagaatttatattctacacagtaaaagccaataaaaatgttataaaatatgtgcaatgtatcaattggtgattattgaaaagataaagcaaaaataaaacaggataacaacatattggagagtaccagaggtgagttactattttatatagcatggccataagtggcttatttgacgttatttaatcagagtccataataaaatgagaatgtaagttatatgagtatctgaggaaagaacattacaagtaaaatgagacctaaagagaagcaaatttttggtatgtctgaggaagaccacaactaggtcagaatggtgtgaatacagtgaaagaagcagagagtatcttcaggtaggttaacaagatgttcaaccatgtcgaaggttgctttttttttgagacggagtcttgctctgtcgcccaggccggagtgcagtggcgcgatctcggctcactgcaagctccgcctcccggattcacgccattcttctgcctcagcctcctgagtagctgggactacaggcgcccgccaccatgcccggctgattttttgtatttttagtagagacgggttttcaccatgttagccaggatggtcttgatctcctgacctcgtgatccaccggcctcagcctcccaaagtgctgggattacaggcgtgagccaccgcgcccgacctgaaccatgtagaagcttttaagatggtaaaaggcttttaattttattcacaatgagaagataaatcattgtagaattttaaatagagaagtaccatgtcatgatttaacttttaaaagacgctctctgggtgatggagagagaaaagagtgtaggagggtagggccataaaaagagagacaacttctaatttctgcagtagtccaggtcagtgaagatgatgatgtagcctaatgtggctcttgtgtaggtgattaatatagtaaaatgtctgtttaggatatatctcaaaatggagttgatatggataatatccatgcagcaggtagaaaggttgtgcacctgtgatgaatatgacatttaactcatttaaatatttaccagattagagaaagaaaggtctgctggacttacacagatgctaaacatacagactttctacactgccttttgctcaagaccatccccctatgatttcaattgttttctgtttctcaaatctcaccctcctccaaacaaccctcccagttgggactaaagtattggctaccatcctatttactgttaacctcatcagcatgtgaattttttaattgtaatatgaatataatgccaggctgtagccatggtgaccaggaactaaacatacatagtttaatcttctttgagaaaatttacttgtccagattcttcccatgtccttggcttatctttggacataattgagtcttctttatctcattttgtctttcaaccatatacattctttctagttatattgatgaccaagacaatattggcacacacttaaaattttccaagtacttatgtccatgtaatctctgtcttctttacatgacttctaaatcaaacttattggagtttacacatgttctttatactaattttgttcccataccattatatttatttcttcaatttatcagatcctataaacctttcctctagtaagacatgacccactcaagacctcaaacactgaggaatctgtttaatatcgtggttttgatacatgtttaattgtgtggataagtgggtgattactagacaatagaacatggttagaagttttctttatggattattagtgaaacataactaaaggagaattatgatctatttgtcctgatacctttgatcataggtactaaaagtgatatttccatgtcctagtaattaattcatacattattattaaaaacagggactagagcacaaattaggaatcccagaagatataagattagaatgagaatgaatttgggatgtttatatttagtctctatttttcatacacgtgttcatacatacatctacaaagtgctaagctctttgttactaattttcacatcatggtaataagttagcaagaaagacagaatatatactattggctagtttgatagagccaaaataatatagagaagcaaatcaaatctgtgggtaaatagatactgtgttagagaaaatggtatgtttgcaccaaattgtatttgtttcatcttcttgataagactgtatttcccaacctctttcacagctcagttaaggtcaagtgtcactctcaagtatggccataaaactgcccatacaatttatctatattctttttttccctgtactgtggcaatcttggaggtcatgtgttttaaactgtttagtcaccttataaaaggaacatggtttcataaatcaccacattgagtaccaataccacccagattaacaacccaacccatattggcatgtgccatgaggaaaaattaaatttatgtttattacaccactgagatatcagtgtttattacttattgcagccaaacatagcctattctcagttatgcatggatggaaaggaagggaagggaaaagggaagggaggagggagggagagaggaaggaggggagtagaggggaaaggagaggaggggaggagaggagaggggaggggaggggaggagaggagaggcgaggggaggagggaaaaaaagaaatatcaaattcagcacaagggggagagaagaagcaggggagataagtttcttgtccaaaagagtagatatgttagacatatgccatttttcattctaatcaaaagtccccaagcacacagaaaccattgaccagaatgtaaccatttgtacatgccaagataaaaattataggtgtttgttagtttcacactgatttcttcaaattaagcaattcaattatgaattaccacaatgtagctttatttgtccatagctttttattttttaatgtattttccagcaaattttttcttagtcaaagacatacttcagtgaatctcagaagcatcttctcttccagaaaactcatacctgttcatttcaagtcattatacactggcagctgaggaagacagctgttatctaaattccataaatactctgtggaggctaaactttagaacctcagtgattccaaactagctgtgttctgaactcttgcattttgatgagcctctccttttattgccttcctgtataagaaaatgttaacaaatcagagatctagattcaataccagactaaggtggttgtataaatgatacataattactggtgaaatgcccatattcttaccattaaaaatagtggagtggacacatttactatccctagatgtcccagaatacttatcttgaccataatgagtttttttatgatccttcatcatatagaaaatttaccacctttaaatgaacacattgttgatgccccccccccaacacacacacttaactttgcagtcgtgtatgtatttctcagtttaattccttaggatgtatgatagcatctaaggaatgtctgttatcttctcataggagaagaataagaaataactatctttacctactttatcgtgttaatgtgtttagcatttttattctatagcacactaatgacttttatgtacaggtttttggactgagtgcttctggcccagccacttatatcattgagtatggttgattttctgtgaacctacacattgcactaatctttctaatacaatgctggagaatcaagctcagagtacaaaacgttgatgttatatttcaaaaggcagatgggattgcgcattatattatatattagaaaaatagggaaggggtactaagtctcccttgtttttctcttcaattggcctgcctacggctcatcaatactggaaataaacagctccagaggctaaatgtggcaaatgcagcaaattcagcaaatccaagtcccttagcattatataatgttgactgcatccattctacagaattttaatttgatatcactctcatgttaatccatttatacattttagtgggcaataaaagaagttatgggcaatcacaaaaagtacatagtagagctatgtgtgacactgatgtcagaaatttatatttttgtggaaaattttaaaaggggatcccatggtggtagatttttaaaattctaataacaattttttaaatttctaataaattaattagaaaaataacttaaatgcacccaagagtggtgaattttaaaaaatcacaaggtaggtaaagctttaagtgaagtgattaaaactgaaagtaagggcatttgagacatgaaaagtgatctaggtcttaagaattacaaactgtgtgtaatgcattttaccaacaataaagtaacatgttctttatccttgcgattaatcattatagtagtccttgggcacccaaactaaagtgagacataaatcaaattgacccaatcaacactcagtaactttaatgacataaacaagcagccagcctttaccaacatcttactacatttaacagtcccgtattactacccaatgtgtggagacagcacagtaggccacaaagagtaccagcttatggaattttggttttacagccgtcactagctttatgaaattgggtaaacaataaattttgtggcccttcagtttcctctaaataatgaaaacaggagtatccattctttcttactatgcaggtagctgcaattgtcaagttaatttctgtaaacctatattgaatattatagcactcaagacaattgtgaaatattagattcgcttccaaataaatttgtttagatgcatggtggtgtttgtttttctggaagaaaattactgagcatcaatggtaatctcatatatatagacctcaggtaaatataggccagattttaattattagaaaaagagctaaactgaatcacttaggctaaacagaaaatgataattgaatttaattattaacataggtgcccatctgtaaccctcactggacattaatcagaccttcattaagacacagttttgtactgatttccatgttttatagataatttatagaaaccgatagaaactgagcagagttcatatcatgaaaaaggggagaaaatacaattatttaaagaaaatgagttagagaattgaacaatatggaaggtcaaaagtttagtgtcagttttcaagcactagataattattgagattcctgcctgttcttcttaatcattttcattttaaccaaccatatatactgatacagttatgttcataacactgcactgtgccagatttaacaaaaataacaccaactaaaaaattaaatatagtccttcccaaggaagccgtgtaggattttgcagtcaattttggggggaaatgggccagcatagataaagcatttaaaaaacaatgctttctttacatctatcataaaggtccagtatgactttataaatgggccagcatagataaagcatttaaaaaacaattctttctttacatctatcataaaggtccagtatgactttataaaaaattagtcaaggagattatttggaaaagaaactcccattaatgttttggactttgaatcctttatgatatttaatactggacggatgagtacctgccttagttaagtcctggaatatgagatgtattttctaggtttagacatgctattatctttctactttaattcttttaaaagttttaaaagagaaattaaatgtaagtttttgaaaagacaatagttaatttatttgtataaggaaaaagtcatctctagtgagtgattgcaattaaaagttaaaaactagcagatgtatactttccctcttatgcacataaaaaccaaatccatactatttcctcttcagttgtttctccgtatatcttctctattactatttatggcaggattattctcccagatatgcccactctgaaacctacttaacttttccttccatttcctttactcctacatccaaatgattggttaaatgccattgaatcgaccactgtactatctttccttaattctaccaattaattttttcttaattccacctctcttaatttcaccaattacatttaaatttaaatttcagcttgtagtattaaaccccattatttatattgcatgttgtggccatacttacctctctaaaattttctcttattgtcaaagtgctactttaaaattttcagtgaattaagtttgtctaaagcatgacatctcaaaatgccatcccagagtcagcaacattaaaatcaccttggagcttcttagaaatacagtgtgtgaagtcttacccggaaacaactgattcagaaattctgaggacgaagcctagtaatctgtatttgaacaagccctccagttttacattttgttgtgttgagactttatttttagagcagttttaggtttatagacaaaatgaacagaaagtacagagagttattatatactccaactcccccacacatacattatttttctatttttagcatctggcgttagtgtggtacattttttagagtagatgaaccaattagaacatattgcatttttttcaaaattcattttactgtggtaagtacacaacatgagatctatcctgttaaatttttaagcacaaaatagttttgttaactattggtacaatgttgcttagctgacttttagaatttattcattttgtatgactttctgtatgtttattaacaactcccaactctccatttctcctactccctgctcctggcaaccactattcattccactctgattctatgagtttgactattttaaatatctcctataagtgaaatcatgcagaatctgttttcatattcccggcttgttttccttaacatcatgttcacagaatttatacatgttgtcacatattacaaaattttctagttttgaaggctgaataatattccatgcatgtgtgtatgtgtacacacacatacacatacatatatatgtcttacattttctcaaccatccatggacatttggattgttactgcatctggaccatcatgattagtgctgcagtgaacatgggagtactaacgcctcttcaacattctgatttcagttcttttagagaattaactaaaaattagtttgctaaatcatatcgcacgtatattttcattttctttttgaggaatgaccataatgtgttccatagcagctgcaccatttggcattcctagcaatggtgtagaagggtggcaacatccccacatcttcaccagtattttttgtctttttgaagatagctatcctgacaggttgaggcagtatcattgtggttttgatttgcatttctctgatgattagtgactttgagcatcttgtcataaacctgttcgtcatttgtatgtcttatttggataaacgtctgttaaaagtctttaacccattttaaaaattgggtgattagcttttttttgctgttgagttgtaggagttccttatatgttttggaaattaaacccttatcagatatattgtttgcaaatttttttttcctattctttaggttgccttttcaatctgttgataatttcctctgcaatgcagaagcttttagtttaatgatatcccaattgtttattttgctttttttgcctacgcttttggtttcatgtgcataaaatcattgctaagattaatgtcatgatgctttttcactgttttcttcttgtagatttctaatttgaggttttacacttaagtctttaattcatttttagttgatttttttgtgtgtggtgtaagttaagggtccaatttcattcttttgcgtgtgtatatccagttttcccaacaacatttattaaagagactattctctcccaattgtgtatcctatactgttttaattaacatagccgtgtaatatatattgctaatcaggaagtgtgatgcctccagtttcattattttttctctcgagtggtttggctttctggtgttttattgtggctccatataaactttgggtttttttttttctatttctgtgaagaatgtcattaagattttgatagagattgcatagaatctttagatagctttgggtagtatggttgttttaacaacattaagtctgccaatccatgaatgtagaatatctctttacttgtttgtgtctctttcaatttctttcatcaatgttttatagatttcaacgtaccagtcttccacctacttactttactcataattattttgttctttttgatgctattgtaaatgtggttcttttcctgatttccatttcagataattcattgttagtgtatagaaatgcaactaatttttactcattgattttatatcctggaactttactgaatttgtttattagttttactaggtttttatggagtttttggagttttctatatagaaggtagaagattatgccatttgtaaacagggagaatttcacttcttcctttctcatctggatgatttttacttcttgatcttgcctgatttctctggttagaacttccagtactatgttgacaaatggtgagattgggcatcctgcctatttcctgttcttagaggaaaagacttaagattttcctattgagtatgatgttagctgtgggcttgttatatatgaacttttctgttaaagtcatttatttctattcttagttcattgagaggtttttgtcttctggttgtaaaaagatgtcacattttgtttaaagatttttatgtatctattgaaatgatcttgtggcttttattctttactctgttaatgtggtatatcccattattttatttttatatagtgaatcatccttgcattccaaagttaaatctcacttggctatggtgtatgatccttttaatgtgctgttgggtttagtttgctagtataatattggaggattttggaatccatatttatcattaattttggactgtaattttcttttcttccgatgcctttgactagcttttttatcaggataatactcacctcaaaaaatgaatttggaagtgttcattccacttcaggtttttggaagattttgataatatttgatgttaattctcatctacgtgtatattagaattcaccagtaaagtcaccaggttctggaagtttccttgttgggaggtttggattactaattcaatctccttgctgtttataggtctgttgaaaatttatatttcttttcatggtttgatcttagtaggttgggtgtttctaggaatgtatccattgatttttttttttctaggctatccaatttgctggcatataatcattcatagtagtctgttattatcatttttatgtctatgggttcagttttgtcttcttttcatttctgaatttatttatttgaatttcctctcatttttttagtttagcaaaaatattgtcaattttatttcttttcagaaaactacctcttaattttgttgatttttttttcaattgtttttctatgctctatttcatttatttattctctaatatttattatttccttctttctgctaattttgggttgaatttattcttttactagtttcatgaggtatagagtttggttgttgatttgagatctgttttatttttaaacgtaggcatttactgctataatcttcccttttactactgcttttgctgaatcctataagttagggtatcatgtatttttgttttcatttgtctcaacattttttaaattttttttatttcttctttgacccatggttgatcaaatgagttgtttaatttccacatatttgtgaagtttctagttttccttctgctatggatttctagttctgttccttttgtggtcacaaaagatatttggtatggtttcaatcttattttttatgtcttgttttgcgacctaacatgtgatttatcttgcagagtgtaccatgtctgcttaagaagaatgtatattctgttacttttttgtggaatgatctgtataggtctgtcacatccatttgaactatagtgttattcatagccactattcctttgttgattttctgtctggttgttctgttcattatttgaaagcttttattaatactattgttgtattactggctacttatcccttccatgctgtaaatgtttgctttatatatttaaatgctttaacgttagccacatatatatttataatcattatgtattccttgtgtatttacacttttgtcattacatattagtaatgtccttctttgtctcttgtgacaactttttacataaaatctatttttcctgatacaagtattgccacctttgcttttttgggtattatttgcctgtaatattttttctttattcttccgctttcagcttatatgaatcattaagtataaagcgagtttcttatacacagaatatagtcatatcttgtttttttgtttcattcattcactctatgtatgctgcaaaatccactgatggttttatggggatttccttgtacactttcctatcattgtattttaagtgtatgttgtatattctggatataagtactttgtcagatatgtaactcataaacattttaacctggtctatgattgtcttttcatgcttttaacagtctctttcacaaagtacttttttatagttttaatgaaatccaacttatcaattatatcaacatatctaaaaacttatcaccaaaccccaaatgtaagattttcttacatttacctttgaagaggttaaagctttgtgctttatatttaggtctatgatccattttgagtcaattccttaatgtgtaaggcctgtgtcacattcagtattttgtatgtggatatgcatttgtttcaggatcatatgttgaaaaatctttcctcagtttaaggatagttgtctgtttagaattgcatttattcctttgttaaagataaatttactatatttgtctgggtctgtttttgtactctccattctgttttgttgatttatttgtctgttgtttgctaataccatactctcttggttatcatgctcttatagtaattactgaagttgggtagtattaacccttcaacttagtgcctcttcttcaatattgttttggctattctgttttttttttatgtttttgcctttcaatataaattttagaatgaatttatcaattgatttatcaattggatacaaagtaacttggtgagattttattgagattgcattcaatctatagattaatttggaaagaactgacaatttaacaatatttagtcttcttatctgtaaacatgagatagctgtccaattatttagatcttcaattgtttcatcagtgttttgtggttttacttatatagaacttgtgcatctttatacacacacacacacacacacacacacacacacacacacacacacacaaggtcttgctctatcactctggacagtggttggaaaggagtggcatgatcatgactcactgcagtctcaacctcctgggctcaagcaatccccttgccttagcctcctgagtgggactacaagagacttttgtatattatccttctattctgcaaccttgccatgattgtttattagttctaagaggtgttttgtttgtttgttttggtttgtttgctttggagtgttttttatgattgcttagtatttttcatgtaggaagttatgtcatctgttaacaaaggcagtttaatttagttattccaagtctgtataccttttatttacatttcctgttttctgtttcatcagctgggacttctagtataatattgaataggagtggtgatagtggacatccttgccttattcctgatcataagaaaaaataatctagtttctcaccgttaactgtgatgttagctgtaagtttcttgcagatgttctttatcaaatagagaaagttctctttctagtttgctgaatgatttttatcacgactaagtgttgcatctttctcaaatactttgtctgcatctgttcgtatgatcatatggtttttcttctttagcctattgatgaaattatgttaatttatttctgagtgttgcaccagtcttgcatacctgagataactgccacttggtaatagtgtatatttctttttttatagtgatatatttaatttagtaatatttttgaggacttttacattcatgttcatgagagatattggtctgtgcttttcttttacttgcaatgtgtttgtttgggtgagagtaatgttagcctcatagaaagagttctattttctgcttctatcttctggaagaggttgaagataattggtctaatttcttcctcaaaagactggtagaattcatcagtgaagccatctggacctgttgctttttgttttataaagttactaattattggtttaatttcatatatatatatatatattcattaagattatttatttctccttgtatgactttagatagattgtgtctttagaggaattggtccattttatctaaattataaaacttgtgaatatagagttgttcatagtgtccctttattattcttttaatatttataggatttgtagtgatggctctcctttcatttgtaatattagtgatttgtagtaatttatgtcttcactcttattatttttttggtgagccttactagaggttaatccattttcaaagaatcagttttcagtgagatgtgtctttgggctgtgcctttcacaggtgcttctcagctttcctctcttcactccttaggtaatacaggaaggctatagagaactagagtttggtatttaccttctaccagatgggttagcctgtagtcaaaatctagttcaggttaggctctggtaaaatacttttccttgaggccaggcctttgttaagaagtatccaacactctggacaaatttcaagtgtttattttttcccttcccctgctgaaagcttgagggaattttcctctgaaatgtcaaactctttacattttggactagaaactagaaaacctctaggagcttttgatgcacacttgattttgagaagtactggcctataggatacattctaaactctttaccatgaattctaggtttgaattaatctgtctccaccaagtttctaatgttattttctgtattctgctctctctatattttctattattttaaaaatatttttatattcattcctatattttatccttcccactttttccttctatccctttgccatttgactataatgctcttttctttctctctttctctacctctcctatcttttttttgtctctttctccgtgtgtatatatacacacacatatatatacacacatatatgtatatataaaatctctaatgtgtatatatgtgtgtgtataatctctagtctataaagatatcaataattctttttcttcaacacatattttaagcgtttattaagtagcagtagaggatagaaggaaaaagaaaatatttttgccgctttccaggaatttattaaccaccacgggagataaaaacatctatacaattccatgccttacatttcacagaagtaaaagtttagacaccagtatagtgtttgtttttatacatacctgtagggaaaaaaaacaaatgcctaaatcattttctaagacctattttgttattcttgaagtgcaacccaaccagtgtcattgaaaatcataagctacataaacatcatattttatattttacatatgaactatctcatttacagaaaataactgcctctagtgaaacgactcaactcttttcatttaaccttctcattaattatttttaaatatttttcaaaattatttggaatgtgctaatttgtaagcctatacattgtaggaaagcagtttttaatcacaaaacagaggtatctaaataaagttgcagaagatagcttctctggtaatgatcaagcagaaatttgatttgtcactgcattctactaaagtaccttgaaggagaaaaggcacccgtaagtatttccacaaagcagccaagttgcctcaagattgtggcttagagcattacatggtatcccgctgaaatgtggcatcaattgttttcaattccaaatgattgcggttttaactctgctcgtagttggagacacagaaactatagaaaagtcagaagaccctctttagatttatcaccttgcataatgatggtgtacttgtaatttactcactcattcaaaaatactgtagtgctaatgtgatggttaacactgagtgtcaacttgactggattgagggatgcaaagtattaatcctgggtgtgtctgtgtggatgtttccaaaagagattaacatttgagtcagtgggctggggaaggcagatccacccttaatctggtgggcacaatctaatcagcttccagcgaatatgaagcaggtggaaaaacctgaaaaggagagacagacctagcctcccagtctgcatctttattccattctggatgtgtcctgccctcgaccatcagactccaagttcttcagttttggtactcggactggctctccttgctcctcagcttgcatacagtcattgtgggaccttgtgatggtgtaagttaatacttaataaacttccctttatatacacgtatatatatatcctattagttctatccctctaagaggaccctgactaatacaaatttctagacaaatagtttctgttgtcatgtggaaagcaaagaaataccttcaatgggaagtagaaaacttccagtgaagcttttgatgttaattacacctgaagcatccactaacacagtacttcccatactttattgtacataggtatgacttgagaccttgttaaaatgcacattatgatgcactttgggcatggccgaagattcctcatttctataaggttcctagttaatgctgctgcttaattaactgtgactagcaagactctagtatatggtaagctttctaaaagaagaggctgtatcttacttgtgtttgcccttaagcctagagatattttgcttacttttatttatcacatctatctatctctctaacttctaaaagttattcaacgctgttcatagagaaatatcagatattttaaaataagttaaattaaaagaaacacggaaatcagggcaaaaggaaaaagtaagattaaggaatttgttaaatttagttttctactagaagcgaacctacgttgtggctccgaacattgatgcccttatgtcctgggcacagtcttggtttatgcccattgcatcaatgtaattattgataaaaacatttactagtctaggttaaacggaacaagcggataccctactgttagccctggtaaataactcttaacctggaaaaacaatgccttacattgattaatgagcagtgtaatgtatggatggaaagagtctttaagcaaatgcccagatattggaaagaaaagatcaggattctatgatattcttaaaacagttattaattttaccactgtgaatattgatggcacattagaccttaaaactatagttattttacatatataggcaatgaatgtttttaaaaatattatatatcaataaaatatcttgatttttttaaactataaattattttataatatacattatgatatttatatataagttcttatctttaggattcttgagaattaacattttagaaagaaaatatctagatgcaaatctagatatataggatgactattaatcttacattccctaaagggacccacaaaaataatgaggggctttctcttagatggatgacttttcattttgcaattaaaaagggtgagaaggcccttcatcaaacttttatttagggcaaaataggtgtcatgaaagaacttaaggccattactaattaataatataaagtaacaaagcagaaaaaaataacctttcatagatttcctgtaggttttaagcagcttcattgattagatcttgatagtagtaagaattctaagaaatacataagataatttagagtatgttcagatatttatacttattatttttatatgcataattgtatttgaaattatatataatttaatttcttattttagaaataagactcttttcaacaaaaaacttaaaatttgcaattattaaatctctgctgatggcactgcccataaaaaagttgtgtttgctaacctaagagaaatttacctaataaaataatttaattgcagagattgtccttgttctaaaataaataacatcttcctaaacatcttactaaaagatctctttcaaatctgctggactgtgttggatgcatctatagtggacttccttcaagcctgtctttcttttaattttaaatacattttcaatttaaataaaatgaccatattctatttaaattacttgtttaactgtgtaacttcctcaccagactattcattctatgagaatagcagatgtgtctttcttgtctttttgatatccagcccctagcatggtactctgcatataatagaggctcagtaaataactgtatataaagcaaaagttgataaagttttagacattttgtatagtaaaaacataatccaaactatagttaaattattgtgatacagaaagtggtagatgacagcaaagttatttaccatctaatctgaatttacaaaatattaaaataatgattaatttgtacaaaaatgtgattgcaagtgtaatattgctttagtctatgtaactatatgctcctttgttccttgcaatttttcaacattttctattgcttcctttcattgttcatcctctttcttcaagtctcaatttaaaggtcatgtcttcagggcaaccattcctgactacagtatttttgtgtgtttcaatactgtatttatttcctttatggctgttatcacaaaatccagttttcttctttattggtttattatctattttccttctattaaattccatgtgagcagtgacattgccagtttttaccattgtattcttaactcctaggagattgcccaacaatttaatgacagaattaatggatggatggatggatggatggatggatgaatggatggatatacaaattcagagatgtgacagtaagttcagcaaaacacatgttcatgaaaacatagaaaaagtaaataagataaagctattctgtttcccacaaaataattcctgatgtatttttatgcttggatacacaagctactgcttgagtctaaaatttatcaaattcatatattagtaatctaggatcatacatcgttgttaagctatgtgtttcttaagatctacctctaatttgaccataggcaatgaggttttggtgctttaaaagcctactcttgctataaaagggaatttatcattttaaattttactttgttagaaatcacttaaaataattaaacacagttttttagtcagtttcaagatataggacatattatttgtacatatgtaagaatttttaatttggcataataacttaagacttattctttaaagtgaatattacatatgcatgggaggagcttgaacctagagatatggtaaaaatatatcagagcaattatatagcttatcttaagatgacagtgatttcaaggttaattcttagcccaacgtatccagacgattattacattctgttcctccttgtgtaggtcagtctggctgttgaaaatgctttcttacttgatgaatcttatcaagttcacattgtggcattttctccagcttttaaataattttttctctaatgtgataaaatgagagtaataagaataatgcacagttgaccatcttgaacaaaaagtgtgggaatacagcgtttacataatggaaaaagaagcagagaagataggctcaaatctccatgtcagggaaaatctgagtagaaaagaaatgacctcatttttgtcaagagtttccttccttcattccttccttccttccttccttccttccttccttccttccttccttgtctttctctctttccttctttctttttcttttcctttcctttcatttccttcccttccctttcccttcccttccctttcccttcctttccttcctttcctttctttccttcttcccttccctttcccttcccttcccttccttccttttctttctttctctcctatctctctctctctccctttctttcctcctcctttgtctttttcttccttcctttcttcctcttacctcttcctcctctgcctcttccttctcttactcctttcttctgtcttcctaaaaagaatagtttttgacacaacactctgaatttctctagggaaatacagtacattcatgttttaaatgtataccttattggatcattgatgccaagggacaagtcaagtctacatcataaaattggtaatcttgtagagatcagattaattgaagttgctttttataaaacttctttttttttatttcaacttttattttagattgagggggtacatgtgcaggttgtgctacatgggtatattttgcaatgctgaggtttggggtatggattccatcatgcaggtagtgagcatagtacccgataagtagttttatcacacatgccccactcccatcctcccccctctagtagtccaggttgtcaattgtttccatgtttatgtccatgtatgctcaatgtttagctcccacttagaagtgagaacccacagtacttggttaactgatcctctgttaatttgattaggattatagcctccagcttcatccatgttgctgcaaaggacagaattttgtcatttttttctggttgcataatactccatggcatgtatgtaccacattttctttatccagtccaccattgataggtacctaggttgattccatgtctttgctattgtgactggtgctgcaatcaacctataagtgcacatgtctttttggtagaatgatttgttttctgtttggtatatatccagtaatgagattgctaggtcatgtggtagttctgttttaggttctttgagaaatctccaaactgctttccacagtggctgaactaatttacattcacattcccaccaacggtgtataagtgttcccttttctccacagcctcaccagcatctgttgtttttttgactttttaataatcaccagtctgactggtgtgagacggtatctcactgtggttcagatttgcatttctctaatgatagtgatagtgagcattttttcatgtttttttcatatgtttgttggcttcttatgtgtcttttgacaagtgtctgttcatttcgtctgcccattttttaatggtggtatttgctccttgcttgtcaatttaagttccttatagattccagatgcaagacttttgtcacgtgcatagtttgtgaactttttcttccattctgtaggttgtgtttactctgttgatagtttcttttgctatgcaaatgttctttagttaattagatcccacttgtcaaattttgtttttcttccaattgcttttagggatttagccaaaaatgatttgccaaggccagtaccagtaagggtatttcctacggtttcttctaggattcttagagtttgaagtcttacatttaaatccatcttgagtttatttttgtacatgttgaaagataagtgtccactttcatttttctgagtgaggccagccagttatcccagggccatttactgaataggagttagttttcctattgcaccacttatttaatagggggtcctttttctattgcttggccttgtcggagatcagatggttgtaggtgtgtggctttatttccgagatttctgttctgttccattggtctatgtgtccatttttgtaccaggaccatactgttgtgattactgtagccttatagtataatttgaagttgaatagtttaatgtctccagttttgttcctttttcttaggattgctttggctattgggcctctttttttggttccatgtgaattttagaatagtttttctaattctttgaagaagatattggtagtttgataggaatactgttgaatctctaaattgctttggggagtacagctattgtttttgagaaattgctgatatatctaagatttaggaaacatgggactaaaactcaaaaattatttcattgcttaaaacttgaatgtacaataagaaatagtttttttttaaatttttgtcaggctttagttctcttatttttaaacagatattttgaagtataatgtgacattcagcctcaaaaacgtcatgctaagtgaaagaatccagatccaaaagactacatattgtatgattctgtttgtacggcatttctagaaaaggtaaatttatagagatggcaagcagatcaatgtttgccctgcagctggggatgggaatgtggaatgatcacaaatgggcacaagagagcattttgaggtgattcaaatgatctaaagctgggttaccatgatgattgcacatctaaaaatcattgaattgtacatttacgaggggtgaagtttatggcatgtaaagtatgaccattttaacaatattgatttttccagttcataagtatgggaataatttttcatttatttttatcatctctgatttccttcagcagttttttgtagttcttcttatagagatctttcacctccttggttagctgtattgccaggtatttcattttctttgtggccacttaaaatgggcttttgttcttaacttgcctcttagcctgggcattattggtgtatagaaatgctactgactttcatacaatggctttttatcctgaaactttactaaaattactagttctagaagccctttggcaaagtcttcagggttttctaggtgtaagattacatcatcagcaaagagagatagtttgatttcttcctttcttacactatcagtggggtgttgaagtgtccaactgttatatatggctgtctaagtcttttcataggccgtgaataacacgttttgtaaaactacttacttcaattttgggtgtatatatatgatacttcagtctttttgttggattataccctttatcattatgtaatgcccttccttttccttcttatttttattggtttgacccttttcccacttagaaaaagaaaaagtgcagcttgctgccagtgctcatttaattttatataaagacactcttagaggctgaagcaaatctgactgattttcaatatgaaaataaaatataaaaactgttcttggagttatttctaaacagaactaatatcacaatcgtctgaataatcagaattgtctattttggaaaaatcaaattcatgaaatgaatctttggccaacaactctttgagaacaatgttaacatcatgcgtagaaatgctgtgttttctaggatttcacattttcagtgattgataattactatattttgtaaatagaaataccactactaaaaacagaatgctataaatagaattctgtcttttgtttctaaagtcaatatgccagagtgacgtgaaaataataaaagtaagatattttgtggaaaaattactactctctctccctactgaaatgtaaactccattgaggcaaagctttctctcatgtttgttcattgctgtatttgagcaactataacattgtcagatgttcaatacacatttattgaatgactgaattaatattaggggacttatgtcatatacaggttctttgttttacatcttgggggcttctgttttctaataatttaaatcctgatcagtatatcatgctgcttctaccacccataaatatacctgcttacttgcttctttctcaagtaaaataaaactcacaagttttattaaagttaactaagatgtctatattttaataaagcatagttattaagcataccagaaaagtgatattataaagttagaatatttatgcagagatatattttaaaataagaatctttagaaactgaaacttagagtataataaatcaattcatttgcttgcaatagcaaatagttgtcacatagaactatattaaagaaatttaatacatgtgaacattaccagtagtttcatgtatggtgcagtttagtaaaattctatcataaagtattttataattatacaaataatttaaaagttatttagtttactacacatcctttttttggttttgttttttacttatcatctttttccatgacagatggttctcataaagctatgaattacaataaactgccttttggttaccgggatagccacattacccaggcttaaccaactatgttcatcaatattactgccgagagagaaagttccaattatacagtttcagattgttgaatataccaatctggctttgcacagttctatgtactaataaactaccttctttgtaaaaattagccttcattgattttctttttttaatttttaatttttgtgggtcatagtaggtgtatatatttatggggtacataagctgttttaatacaggtatgcaatgcatagtaattacatcattgaaaatgggatatccaaacccttaggcatttttctttgtgttatgaaaaatccaatttcactattttagatatgtttaaatgtacaataaaatcataattaaccattgtcaccctattgtgctatctaatattaggtcttattaattctttttaaatacttttttttactcattaacaattgccacctctctcaccctgacacccattacccatcccagcctctagtaacgtaacccgccttctactctctatctccatgagctcaaaggttttgaattttagatcacacaaaactatgcttatcctaagtaaaaagagtaaataatcaaccaatgaaaaataatgaccataacaacttttcatggcatagttcaataggatataaacagaaacaataaaaagttaagaagcagagagacaaagttaagacagagtttttactcggtttatttttgcttttttgtttgtttatgcaaataacataaagttgttatcaggttaaatattacccactccactgccctttccagccttgaaaactatccttctactctatctccatgaaattaattgtgttgatttttagatctcacatgtgaatgaaaacatgtaaagtttgtctttatgtgcctagcttattttacttaatgttctgtagttccatccctgttgttgcaaatgacagtactacattgtgtatatgtaccacattttctttttgcatttgtctgttgatagacacttaggttgatttcaaatcttggatattgcaaataatgctgcaacaagcatagaagtgcagatatctcttggatgtactgatctcctttcttttgggtatgtacccagcagtgggattgctggatcatatggtagctcaatatttagttttttgaggaacatgcaaatgattcttcatactggctgtactaatttacattcccaccaacagtgtgcgaaggttcccttttctctgcatcctcgccaacatttgtttttctagggtaagatgatatctcattatagtttttatttgcatttttctgatgatcaatgatgttgagcaccttttcatatggccatttgccttttgtatgtcttcttttgagaaatgtctattcaaatattttactcattttaaaaatcagattattagattgttttctacaaagttttttgagctctttatatattctggttattaatttcttgtcagataggtagtttgcaaattttctctttaattatctgtgctgtctcttcactttgttgtttagatcaggggttcccaacccccgggccatggactggtactggtccatggcctgttaggaactggaccacacagcaggaggtgagcagcacgagagtgagcattaccacctgacctttacctcctgtcaggtaagcattggcgttagattctcataggagcacaaaccctactgtgaactgcaaatttgagggatctaggttgcgtgctccttaagagaatctaatgcctgatatgaggtggaacaatttcatccccaaaccaactcccctcctgtcccagggaaaaactggcttccacgaaactggtccttggtgccaaaaaggttgaggaccactggtttagctcctttgttttacagaagctttttctctttatgtgatctcatttgtttatttttgctttgattgctagtgcttgtggggtattgctcaagaaatttttgcccagaacaatgtcctggagattttccccaatgttttcttgtagtagttccacagtttgagatcttagatttaagtctttaatacattttgattttatatttttgtatagcaatatgggatctagtttccttcttttgcatgtaactatccagttttcccagcaccgtttattgaagagacggtcatttccccagtgtattttcttggtacctttttcaaaaataagttcactgtaggtgtgtggatttgtttctgggttctctattctatgccgttgatctacgtgtctgtttttattgcagtaatatactattttggttactatatctgtaatatgattgaagtcaggtaatgtaattcctccttttttttttttttttttttgttaagataggctcggctgctctgggacttctgtggttccatataaattttagaattgttgctttttctttttttgtgaagaatgtaattgctattttgatagagattacattgagtctgtagcttgcttttggtaatatggacattttaacaattttgattcttctaatccataaacgtggaatatccttccattgtttggtgtcctcttcaattatttcttttatcagtgttttctagttttcattatagcaattttcacttctttggttaagctcattcctaggtatttaattttatgtgtggctattgtaaatgggattacttttttattttcttttcacattgttcactgttggcatatgaaaatgctactgatattgtatgttaatattttatcctgcaactttactgaatttgtctatcagttctaatagttttcctttgaagtcttgaggtttttccaaatgtaagattatatcatctgcaaacagaataatttgatctcttcctttccaatttggatgttggttatatctttcttttgtcttattcctctagcaaggatttccagtactgtactgaataacagtggtgacagttagcacccctgttgtgttccatatcttagaagaaaggctttcacttttttcccattcaatgttatacgagctgtgggtctgtcatatacgacttttcttgggttgacatatgttccttttatgtccagttcgtttagcgtttttaatgtgaatacatgttgaattttttcattttttcaacatccattaaaatggtcatatgtttttatccttagttcgttccattgatatggtgtatcacatacattgatttgcacatgttgaaacattccttcatcccagggataaatcccacttgatcatgatgaataatctttctaatgtattgttgaattctgtttgccagtattttgttgaagatttttgcatcaatattcatgagatatattgtcctgtaattttctttcttttttttttttttgatgtttggagggtaatgctggccttgttttgtaagtttggaagtaatctcactgcctacatttttcggaagagcgtgagtaggattggtagtatttcttctttaaatattagttataattcagcagtaaagccaacaggctccaggctttcctttatttggagaatttttattatgacatcaatctcgttacttgttattgatctgttcaggttttggatttcttcctggttcaacgttggtaggttatatgtatttaggtatttgtccatttcttctaggttttccaatttattgatatatagttgctcatagtagccactaatgatcctttgaatttctgtagtttcagttgtaatatctcctttttcatatctgattttatttatttggaacttctttttttcttagtctggctaaaggttggtcaatttttttaacttttcagaagaaaaaccacaactatttgttgtattgatcttttctattgttttattcatttcaattttatttctttctgctctgatctttatttcttttcttctactactataattttgattttggtttgaccttggattttaagttcattaagatgcatcattagattgttcttaaaaagtttttcctctttttaaatgtaggtccctatagataaaagcttccctcttagtacagttttttttttttgtatccaataggttttggtatgctgttattttattatcatttgtttaaggaaatttttctctgttttttctcaatttcttcatcgacccactggtcattcaggagcatactgtttaattttcatatatttgtatagttttcaaaatccctcttgttattaatttcttgttttattttattatggtcagagaagatatttgatataattttatttttttgaatgttttaagacttgttttgtgaattaatatttgctctgttattgagaatgatccatgtgctgaggaaaggaatatatattctgcagcttttggatgaaatgctctgtaaatatttattaggtccatttaatctatagcgtagattaagtttgatatttctttattgattttctgtctagaagatctgtccaatgctgaaggtagcgtgtgggtctccagctattattgttctgtgttttctcattctcttttgctctcatagtatttgctttatatatctggatgctccagtattgggttcatatatatttaaaattgttaggccaggcacagtggctcacacctgtaatcccagcactttgggaggctgaggcaggtggatcacgagatcaggagatcgagaccatcctgaataacacggtgaaaccccgtctctactaaaaatacaaaaaaatagccaggcatggtggcgggcacctgtagtcccagctactcgggaggctgaggcaggagaatggcgtgaacccgggaggcggagcttgcagtgagccgagatcgcgccactgcactccagcctgggcaacagagcgagactccgtctcaaaaaagaaaaaaaattgttatgttctcccgctgaattaacccattttctttacatagtcgccttctgtgtctcttatagtttttgccttgaaatctattttgtctgatgtaagtgtagcgacttctgctcttttttggtttccattggcatggaatatctttttccatccctttattttcagtctaagtgtgtctttatgagtgaagtgtgtttctttttggcaacagttcagtgagacctttttttttcatccattcaactagtctatcccttgtcattggagagtttatttcatttatattcaatgccattgttgataagcaaggacttactcctgccatattgttgttttctagttgttctatggtcttctcttcctcttttcatttctttccaccttcctctagtgataataattatctctggtaatatggtattgttttttggttttttttttgtatttactatatgctttgtttatttgaggttatcatgaggcttgcacatattatcttgtaacctattatttaacctgataaaaaccttatgttattttcataaacaaacaaaaagtcaaaaagaaaactagtaaaaactctatgtcctaactttgtccctctgcttcttaactttttattgtttctgtttatatcctattgtactatgtcatgaaaagttgttgtggtcattatttttcattggtcgattatttagtctttctacttagggtaagagtagtttactcatcacaggtacaatgttaataatatcctatgttttcctgtgtacttacttttatcagtgagttttataccttcaggtgattgtttattgctcattaatgtcttttactttctgattgatggacttcctctagcatttcttgtaggataggtttggtgttgatgaaatccctccgcatttgtattaatacccttaattttacagaagataaaatttacttgagagaagttaagaaaattatcccttgctagtctactagttagtgaatgttccaaaaatcaccaaatatcctaatattcagtcttcttattttaaatatgtctttaaaacttttttgatgctttttcttctgcctctgctgtttcttctttctttgtgaaaacatctactttttatactgttatgaaaaggaatattgatacaactgggtccttttacttaagtacaacttctatcagttctgcaacttcatgaatacttagtggatttggtaacatcaattgtctccaaccatctgtttgtagcttattacagaaatgtgattattttgccttaggggatccataatgagctccagaaaatcctagatgtcatctccattttgagctttttaaccaattctcgcttctcatatattttctttttcttatttagtagaccagaaatgtagagaaaccccatggccatcaccagccattactttgtcattcttctaattccctacttctaagtttctactttatttaaatgttaacattttttaaaatctataaattattttttgtgaggtgtaatagagatttcccttgatcagtaaaatacatttcatcttcatagtatacaactataagtgagtagcagctggccaggaaaagttcatatttgcatgcacccatatagttatgaacatatgattagttttcatcaatggaatgtaggtgaacatagtgagtgccacttttggatcaagactttgaaaatataaatgtgccaccttttttcctgtttctcttcattgatttgctgtatatttaaaatgataaggcctatgagctgtactgttttatatggtggccattagccacatgtgactatttcaatctaaaataattaaaatttaatacaatttaaaattaagtttctcatttacactagccacatttcaaaaatataaaggttatattgtcattattgcaaaatctgttattgaagggcactgacttagataatggtagagataagatgcagagagccttgttcattgcatcttagtgaggagagccaatcagctattcacctctgatgagtgcatgaaataaacttctagtttagtccagtgtacatctatatatttggcggtctttatttcttagtattttagattgtcctagttgacatagaagctaagtggtaattttaaaaatattttaacatctttttagacatttggaagatttcctacctccttttatttttttatttgtttttttctacatttaaaatcaaaacaatatagaatatgtttttttaaagtagaatgttttaagatgtagtgtattcaagaaaaaagtccaatagaaacttctcatggtaatgcatccacagtgaaaaagccatgatgaaacttcaggtttctttttccaccttcttaccttataagataatatccttaaaagtacaagcccaggaagggcatggtctttgggctcagattctttgggtttgagtcatgattctaacacttcatatttacaacctttgtagttttatggccatctataaataacaataatcgaaaaagtcaccagagttctgcacatagaaaacaatatatcagtttaattgctgataaaacctgggctggagaatatgaattagatatgtggcaataatgagcttcatgatactcctgaccccaccaatttagatattggcacagtctactgcaggcaaagcttgagtcttcaggaaagacttgcacagaattgttgcctttcactgcaggagggggttgagaaggagagtagagtgcaaattttcaaagtttaggaatttcaatacattaacatcaccaaattcatagatttggaccaaggtatatctgacaattcaattagccactgttgagaggcaaagaagtgtagcagaagaccagaataatataaggaaaatttattgtcaagaaaaccagagaaataatagagaaggctttagcattgtgagtttgtttctttacagtaaatggagatggtaatagtgcttaggattgctatgaccattaaatgctataattttagtaaaacatataatgctttatgaatggtaaacttttactaattctattagtaataataatgtcattttttattgttgttgcctgaacatttatagttgtagattaattatttggtaaacttactggaggggtgatgaagcaaagttgattaatgggtacaaatatatagttagatagaaaatataagatctttagtttgatagatcagtaggtgattataattaacattaatctattgtacatttcaaaatagaagaaaataattcaaatgtttctggaatacaaatatataaatgtttaaggtcatggatatacaaattacacccacttgatcatatggatatatcaaattttcacgtgtacctcaaacacatgtacatctattatgtataagtacaattttatttaaaaagtaaacattttagtttttatgaagtagaatttttttaatgaagctagaaagaatgaatacttgggaattcctaagggatgacaataactaatgaaagttttatggaaagtaggaaagttgctgttttattttctctgtaaatttgactggctctggatcaggcctgaaacaattgctggcaaacaatatgggaggtaagttttgtatcttaatcaaaaaattagaaattaagtattcattctttgaaatagaaaatataatgagcacatattattataattagcatttgcaactggaaaaatattggggaccattaaaatttaacaggaatggaatcattcttccatctattaatttttactaatctattggataattctttagtgtcatagtacatcacattgcactgtgggcctgttggggatgcaaattagctcaacattcattctgtcttcaaaaacttgtagactaatatatggaatttagttctaaatattataatccttataatcctataataaaaagtaaaaattagagctttgggagtttagagaaaaatattttcaattgtagaatttagaggaagtattattttcagctgtggtgtggtttgggggaggaaagcttcaagggaagtttgaaggaggagatagcatatgaactcagttacatttggacaaaagtcatggtggtagggttttccatgccaatgaaacaagaggtaaaaaaattatttccatctgggtaaattaaagatacacaaataaaacagaagcaattaacaaatgtaatataaattatttgccaaataattttatagttttacttagtataagaaaaatgttgaacttatgttaatagatctagataatctaaaagctaaaatgtttaagattgacttaatttagaaagttttgaattggtttaaaaggaatgaatgaaaataaacgaatgacttagatgtaatttctgaggaagttttatatgttaatagtgagctattctaaatcttgctaccttcttatagacacattggaataagaatcagttgtacagatatgtactaaagatgatggaatcttgaagtgaatgtacaacataaataagaaatgtatatcattctctttaacatgagcacgtagtatttttaaaactaacttgaaatatagtaaattgtcaaatttaaaatacaggtttggagtattgcattcaatttcaattataaatctcaaaaaatatgagtaatttcagaaactttacaagtaataaaacaaatcttcaattgttattattttattgggtagataaaataaataatataggcaggcacatgtacacatacacacacccatgcatacatagattcacagagatgcacataaacagcatagcacatgcaagttatttatgcatgaaaatttttaaagttatactattataacaggtatagtgccatttgtttaatctctttaaatgaaagatatttacatttaaaaatattccagtaagattcactatgcctattatattttaactttttataatttctattatgtttagtgttatctgtgatattgggccatgcataaaagctaacaataaagaaatttccatgtttccacactgggctgaatatatcctgaaattgaatactgaacaatgaattatattatgcaaaacagaagacatacaagcagaaaaggctgaagtattttaatggcacttcaaacgcttcacataatgggaacatagatggaggcacactttttttctttgatggctcaacccctctatttcagtttcatgaaccttttgttcatgtcctctctaaaagaattttaaagaacattttagatgttgcacatttatgatgtcatatatttttattatctaagttttattatctagaagtggcaaaagatagaatttttggcatattgcatacattgtcattttaaataaaacagttacatttgcttaaaatatctcagatcatccaaattccataatgatctgatacaaccaaactgttacacaatataatgaataaacaaactcttatttcaaaatctgaaattacgtattatttgttttcccccttgtaattatataaacagtgcacttctttcacataaacttaatataatacattttgtatttgaaaattcttattgatcaaagcaacttaagtttcttcagcaaaataatatgtatctaaattgaaattatattttgtaaattttcagttaccataaatctctaaatgctaaattttcttctgtttggttgccaattgtaattcttagtagtaaacaataggtcaaaacaacatgcatctttcatcaattttgggaaataaccaaagtataaaaattattataattatttctaaatgagatggatgagttacgcttttgttttttcaattgacttattatgtatctgtagatagatattacttattgctacagtgagtcaaaacacaatattctgttttttttctcatttaatagggataagtgctgagtaaacctcttcataaacaaatagatgataatacagttatgatgttacagcaatgtttctcaagtctttgtacttttttttttttttttttttgagacggagtctcgctctgtcgcccaggctggagtgcagtggcatgaactcggctcactgcaaggtctgcctcccaggttcacgccattctcctgccttagcctcctgagtagctgggactacaggcgcctgccatcacgccaagctaattttttttttgtattttttagtagagatggggtttcaccatgttagccaggatggtctcgatctcctgacctcatgatccgcccgtctcggcctccgaaagtgctgggattacaggcgtgagccactgcgcccggccactttttgtaactaaatgaggccttcttcaattttgttgtaagcaaataattggaaatccctcaaattgcaaaatgctttgatacctagtcactggtggaattaatttccttaacataagcagtaattttgcaaactgttgaattgttaaacctataggtattaaaccactggacaactctaatataattagtcaaagggaaggctttcttttataaaataggaaaatagtgaaggtgaagaggaagtgggaaccaagatgatgccttcaccctgtgaaaggtgtatgctcacttttactcatacaaatccattttgggacagacaacacatggtatttcaggatacggtaattgctttgctttaaaattatctatacccttatatctttttgagtgtcttcaggtagccaagaggttgcaggcagtggaattggctgttgtttttcatccctgtgagcagggttattctgtcatgagttgctgtaatggcctgaggtagctggcctccaaccaggaggtggtgctttcaagagagcaccagccacaatggtagcagaaggatctaagcttgccctaagttggccagggaaagtattctggtttctcaggtggtgggtggggtcataaagttcccaggagtttatgtcttttgtgtttggctaccagggcgggtagagaaataccatcggctgggggcaggtttaggtgggtctgggctcagactctccttgggaagggcttgctatggccactgtgaaggatggggatgtggttctcaggccaatggggttatgctctggagattattatggctgcctctgctgtgttatataatttgccagagaagtccaggatggctggtagcaaaaaacttcactcagcttccacgcggttggcaaggtggtcttgttcccacagtgccctgctcagatcttgccccaagctatcagcttccctgttgagaaagcaagcttgcctttcaggcctccccctatctcatctacccgcagtatttgctgtgtctccctgtactcgtatctgcatcagttctcatttgccccctggattctgctcaagaaaatttatgcccagttgaaattattacgaatttagttcgaagcgtctttcacactgtgacccctccctaatcctgctggctgccttccccaagggcctctgtgagatatagtctgggatggcttccctgggaacgagctggagactggaagtgcctacaagtctcttcttgcttctgtttctacttttgtattttgtgcaactccctaaatctgtttcagctataggtaaggttaaatccttttcccatgatctggattttcagattccctagtggggatatgtgtttgaaggtaggctttctccctttcacactttgggaactcacagtttttcacttgtctcatggaatttgcaatagtgtgccacttctttaaaaggacctgtaaattatttcagttttctggtacatttctgtgatggttcttggagcaaaagttcatggtgtgagtctctacacactgttctgtctatctaagtggtagctgcatgttagccctgtcttctatctgccatctttgctagattcacctgtattatctttttgatttgttgttggcttcacgttagtggtattttgttggatatttttgcatctatgtttatcagggttattagcctatagtttttggtttcttgcatccttacttggcttttatatcaaagaaattatggcctggtacaatggattaagaacattttccacctattcagtttcttgaaacactttgagaaaaaaaaaatggttttcgttcttttttatgagtttggtagaattcagctgtaaatctgtctgtccctaggcttttcattgtttggagcttttttattactgattcagtcttattagtcactattggtttgctcaggttttctaattattcacagttcagtcatggtagactatatgtttctgggaatgtatatattttctctggattttatctaactttaaacatagtcatttataatttttaaattttttaaatgtaggatctgttaaaatatctcctttatatatgtaattttatttatttggacgttttcttttttctttttttatggttaagctatctagtattctagcaattttgtgaatcatttcaaaaaaacaaagttttgttccattgatcttttgtattgttctttgtccctattttgtttagttttgctctgacctttattattgaattcctactaattttgattttggtttgttcttacttttctattttcttgagttttatttgtaatatttctacttttatgatgtaggcatttatataaacttttctcttgccactgcttttgctctatttcataggttttggtatattatatttccattattatttatttcaagaaatttaaaaattttcttcttaatttctttatgaatacaatggtcatttaagatctggttatttaatttcatgcaggttccaatgtacctcttatttttgatttctagttttattcttttgtggtctaaggtacatgacatgatttcaattaaaaaaaaatcctgagacttattttgtgttctaccatgtgatctatcctaaagaatgttccatgtgctgatgagaagaatgtgtaccttgcagctgttgtataaaatgttctgtaaatatttgttgagttcatatactccaaaatgcaatttaatgttttttggtcatttatttttgtctagatctagatgatatgtcatatgctgagattgggatgttgaagtgtccctctattttcatattggagtttcctctcacatttgatctaataaaagttgctttatatatttgggtgttctggtgttcagtgaatatatatttacaatcattatatactcttgctgaagtgatccctttatcgttatatagtaaccacctttgtctctgtttatcattttttactttaaatctgttttattttatgttagtgtggctactcttgcacacattggatttctgtttgtgagggctgtctttttccaatcttttacgtttattctgtgtctttacagatgaagtggcttgcttgtagacatcatatacttcagtcatgtttttgtaatctattcagccaatgtgtgtcttttaggtgggaaatttaatccatttacattcactattattattgataggtaagaatttataattatcattgtgttgattgttttctggttgttttgaatgtcctttatttctttctctattcaataaggaataatcgtttctctattattgtttatagttatgtttgttggctttctgtaatggtaacttttcaattctttcttgttttcatttgtgcatctgctttaccagtgagttttatattttcatgtgttttcattatggtggatattgcccttttacttccaggtttagggctcttaaagcatattttagcaccagtctagtggtgatgagcttcctcattttttgctagtctgggagagactatacatatccttccattttaaggacatctttgctaggtatattatacttggctgacactttttctttcagcactttaaatatattacacattctctcctggcctgtaagacttctgctgagaaatctgctcatggtctaatatggattcccttatatgtgacttgtttcttatgtcttgtagcttttagaatcctctcattgtctttgaattttggcattttgattttaatttgctttggagaaaactttactgagatgaatctatttagagattttgagcttcctgtggagagttgcaatgtttttgctattctcttgatgaaataattttctatgcctttgcccatctttttccctggaatttctaaaactaatatttggttgctttatgtttttttatatgtctcataggctttttttatctttttaatttattattctttcttctttttctgactgttatttcaaaatacctatctttaatttcagaaatcctttatactgctagatgtattctattactgaagtactcaattacgttttttttattgttaattcttgtgtgtacatagtatgtgtatgtatttatgaggtccattagatgttttgatacaggcatgcaacataatcacattgtaaagaatggagtatccatccactcaagcatgtattctttgtgttacaaacaatccaataacattctattattttaaaatgtacaattaagttattttaaatgtacaatgaagttattatttactgtagtcaccctgctgggctagcaaacagtaagtcttatccattttttctactttttgtatcaattaactttccccacctccccctcaaccccccagtaccctttcctgcctcttataatcatccttcgattctctatgtccagagttcaattgttttgatttttagattccacaaataagtgagaacattcaatgtttctctttatgtgcctggcttatttcacttaacataatgatctccacttcaatccatgttgttgcaaatgacaggatatcattctttttatcattgaatagtactccattgtgtatatgtaccatattttctttatccactcgtctgttgatggatatttaggttgattccaaatattagatattgtgaacagtgctgcagtaaacaagggagggcaaatatctctgtaatatagtgattttctttcttttgggtatatacccagcagtgggactgcttaatcatactggtatctcaatttttggtttttggaggaacctccaaactgttctccatagtgattttacttatgtacattcctgtcaacagtagacaggggctcccttttctccacatcctcactatcatttgttactgcctttctttggatataagccattttaactggggtgagatgatatctcattatagttttgatttgcatttctctgatgatttatgatgttgagcaccttttcatatgcccatttgtcatttgtatgtcttcgagaagtatctattcaaatattttgcccatattttgatcagattatttgatttttttcaatagagttgtttgagcttattacatattctggttaataatcccttgtcagacagtaaatttgcaaacattctctctcattctctggaatgtctcttcactttgttgattttttatttgtttacagaagctttttaacttgatgtgatcccatttgtcgtttctactttccttgcccttacttgtaggttattgctaaaaaaaaattgaccagaccaatgtcctggagattttcctcaaagcttccttctagtagtttcatagtttgagatcttagatttaaatctctaatcccttttcgtatgattttatatatggcaaagggggtctagtttcattcctttgctcatggatttctaatttccaagcaccattaattgaatagactgtgtttttcccagtgtatgctcttggaacctttgtcagaaatgagttcactgtaggtgtgtggatttgtttctgggttttctattttgctgtattggtctgtgtgtttttatgagagtaacaccctgttttggttgctataactctatagtacaatttgaagtaaggtaatgtgatttttcagttttctgctttttgtttaggatagctttggctattgtgtgtcttttgtgctttcatgtaaattttaggattttttttctttttctgtgaagaatatccttagtattttgatagggattgcatttagtctgtagatggcttttggtagtatggacattttaacagtattaattcttgaaatcaatgaacatgaaatatcttcatttttatgtgtcctcttcaaggtatttcatcagtgttttacagtttttattatagaggtctttgacttccttggttaagttaattgttaggtatttaattttatttaattttatgtgtagctatcgtaaatgagattaccttttaatgtctttttcagattgttcactcttgacatatagaaatgctactgatttttgtatgttgattttgtatcttgtaactttactgaatttatcagttctaatagtatttttgtgtagtctttagtttttttcaaatataagatcatatcgtctgcaaacaaggatactttgactttttccttttcaatttggatgccctttatttctttttttttgtctgattacactagccaggacttctagctatgttgaataacagtggtgaaagtgggcatccttgatatgttcccaattgtagagaaaaaatttttatattttccctatttagtataatactagtagtgagtctgttgtatttagcttttattaagttgacatatgttcattctataagcagttttttgagaagttttattctgaagggacattgaatttgttttgtacttttagataatttctccctgctcattaacatccttttttctgattgaaatactaccgttagcatttcttgtaggataggtctggtattgatgaaattccttagctgttgtttgtatgggaaagtctttatttctccttcatgtttgaacaatgttatcagcagatataccatttgaaactaagtactttttttctttaacactttaaatatatcatgccactctctcctgacctgtaaagtttccattaaaaagtctgctgccagatgtattagagcttcattgtatgatatttatatattttatcttgctacatttaggatactttctttatccttgaccttttggagtttgatttttttttttttttaagactgagttttgctcttgttgcccaggctggagtgcaatggcgcaatctcagctcaatgcaacctccgcctcccgggttcaagcaattctcctgcctcagtctcccgagtagttcggattacaggcatgtgccaccacgcctggctaattttgtatttttagtagagacggggtttctccatgttggtcaggctggtctcgaactcccgacctcaggtgatctgcccactttggcctcccaaagtgctgggattacaggcacgagccaccacacccagccgggaggttgattattaaaggccttgaggtagtcttctttgggttaaatctgcttggtgttctataacctttttgtacttaaatatttatatcttctgtgcagcacaccaacatggcacatgtatatatatgtaacaagcctgcacgctgtgcacatgtaccctaaaacttaaagtataataataataataataaaaataaagcttctgcttcagtgcagctaaaaaaaatatttatatctttctttaggtttgttctcttttattatccctttgaatgaagtttctactgctgtctttttctctactctctctttaaggccaataacttttagatttaccatttcaatgctattttctagatcctataggtgtgcttcattgttttttattccttttccttttgtctcctctgagtgtattttcaattagcccatcttctagctcactaatactttcttctgcttgatctatactgctcttaaaggactctgatgcattcttcggtatgccagttgcatactgtatgccatttttcagctccagagtttctgcttatttttaattactccaatctctttgttaaatttttctgatagaattcttaattccttctctctgttatcttaagtgtctttgagtttcctcaacacagctattttgaattctctttctgaaaggtctcatatctctgtttctccattactggtccctggtgtcttattttgttcattttgtgaagtcatgtattcctggatgatgttgatgatagtagatgttcttctgtgtctaggcattgaagggttaagtatttgttgtagtttttactttctgggcttatttgtagccattattcttaggaagtctttttagatatttaaaatgacttgggtgttgtgatctaagctgtatctgctttagggagtaccctatgtccagtaccagtgtggttcttgcagacttgtaaaggtactgcctttatggtcttggacaagatccaggagaattctctggtttacctggcagagacatgtattctcttcccttactttttccaaaacaaatggagtttctctctctctgagctgaactacctaaagctggatgaagtgatacaagcacccctgtggccaccagcactatggctgcactggatcagacctgaagccagcacagtgcttggtctcacccaacgcctgctgtaaccatttcctggctactgccaatgttcactcaagactctggggctttataatcagcaggtatgaaagccagccagggctatatccatttcttcagagtggcaaattccctgaggtcccaggttggtccagtggtgctgttcggtagtcaaggactagagtcaaatccttagaaatctacttcatgttctattatactccagctaagctggcactgaaactacaaggcacagtcctttccactctcttcacgtttttccaaatgcagaggagcctcgctccgtagtcactgccaccacaggcaacagggagtactgccagactagcaccaatgtatttttaaagcccaaggacttgtaagtcagtttctggtgaatgctgcctggcctgttagtcacttttcagggcagtgagctcccatctggccctggacaggtccataaatgccatttatgccccctgttctgggattggggaccccgagagctcacttgttgctctaccatcctgcagctgagctggtacctaaggttcaagaccaagtgccctttacttttccttctgtttttctcaagaagaaggaattttgccccatagccaccatagctggtagtgcactgagtctcacctgaagccattatgtcttagaggctcattcaaggccctcaacatggtacgtgggtatcactgctggttattcagggcccaagagctctttagttaacaagtgatgtatactgctaggaatgggttcttcccttcaagtcagtggattcccttgtatctcagatgttatctagaaatttcttccagtagctagtgcctggaacaggggcttcatttctcttactggtgccctattatactgtggctgaactggtatccaaaatgcaagacaaagtccatcccagtcttttctctcctctcaaatagagggaaggggtgtcttttgtagctgtgagctgtgcttcctggggttaggggaggagtcatgccagcacttccttagccaccccagctggagtctcagtaggttacaggccacccccaaccccgtcaccaaccaagttcactgtctcttggcccagttcatcactaggacttgcctcagcgtcgcagtccttgtggcctctcctgtctttgaggtttacttttagacccagagcactttagccctcagtggtgagcaaggtatgtaagaactcaaattttcaccattgggatggcaagtccccttcagctagaaatgctccttccatgggcaagagtcagctgagtttggtctggttttcctttctgctctaacagcacagctctgagttcaatgcctcacaattactatactctctctcccccagtaccctgagatgctctccacaccatgccaatcctgctgggggataggaaagtagtcatgtcaatgattcaaaactactttttctgtctcctcactgcctatcccagtgatatgaagttaaaaccagtactctgaggactcacctgatttttgtttcttatgaagttatatatttttttcttttctgtataaatagttgtaaaattggtgtcctcacatgggggactatcaattgagcattctattctgccactttgcttcctctctctctcatatattttcttgtttgtatttttttattacattcattaattttttagttctagagttcccatgtgtttcttttttaagatgtctatttctttgttgaatttctcatttatatcctgaattgtttttctcgtttctttgtattatttttccatattgtctttatcttactgagcttttttgataacattatttctatttttttaggcatttctttcttgtttttcttttttggagtcggagtcttgctctgtcacccaggctggagtgcagtggtgcaatctcagctcactgcaacttccacctcccgggttcaagctattctcctgcctcaccctcccgagtagctgggattacaggtgtgtgccaccatgcctggctaattttttgcattttagtagagatggggtttcaccgtgttgtccaggcattagcagtagcagtagcagtggtaggtcaaccgttgggcctctgagcagagcacacgagcaccagtagtggcagcagcaggctggacagactattccaaggccatgaggtggtgcctaaaggagagtgccagagactgcaccagtggcggtaggctgggtagactggtcacttggcccctgggatgtgcatacagtcactggatgtggcttgaatgggcctatttttaggtccccagaaggtgtagatgggtaccagtggtggttgctgggctgcattaatccccaggaacccagataacgtttgtgggtggtggtcatgttgagtgggacatacctgtcctcaagcccttgagaatgtgcaagagcaccagcgtccagtggcagggtggatttatctctaggcctcagataacatttgtgggcactggggggtggtgatggtgggtggaacacatctttcctcatgtccctggatcatgtgtacaggtgcctgatgtggcaggcagggcaggttgatccctaagcctccagatggtttactgggtctctggtggcagtagtggtcatcagtggtacagatttattcttaggccactgatcagcatgtgtggtctttagtagtgacggatggattagattgattcccagttcccctggcggcatttgcaggtgcctggtagtcctgccactggtaggggaaggattgctatcaatggcagtggtcccaggcaaacaactctcaggatctggggagcatacacattggttccctttgtcctggaggcagccttccagatggactgaaccatccattacccagagtgtaagacactgtgtgagctagagtgctggggaccctcctgcaccactggatccagttggtggtgtgatactgcagccctctgagtgtatgtggagagatgtcagtggggtttcagaaatgaggaaatgcagggattattggaccctagggcaggatgcagtctggggtgctggactctcaaaatggcactgtgctgcagatgcttgggtctcaggggctgtgtgggactcagtgtgagctttctctctggaacaacaccatcacgtggattccacgcacctctgcgtactaaccttagggcctggaagtgctctcctgtggctacaattctaagaatccaaggtgcgaatgttgacggctggagatatcttgcttaccttttcccagcaatagggagttcctgctggctacaagccaattccagtggggctggttgctttgcttccctcttgttctgtgcctcagagtttccctgtcacttcactttggaattccagtgttctctcttagaagctctatttaatgtgtggttagctcactgttaagttgttcttttttggagaaggcaagtcccggtcacctctatttagacattgtgaatccccctcctatactgtgttttatctatttaaaggaaacaacaataaactgttaaattaactgcagcttttcttatcaatttattcttgcttataaatctacaatcatttttaattaaaaaatcttttaaggctttcatatgaatagctttaaatttataattcaatcaaaagataatagacaagaaaaaacagaatgtagtgtgatctttttacattttttatactaagtatgccatatgtatttgagaagtacatagcaaatatcttactaatagagctgttaagattatggtttgtgggttctgttagccaaagttgaaaccccacttgggtattcactgattatatgaacttactcaaattacttcttaatgaatatttctttctccatctgtaaaatagtacctgtctcataaggtttttgtaaataaggcagtccatgtaatttgttataatacttggtatgtaattgatgttcagtaaatattatttgttgtaatttttaaacatatcatccttaggataaactccaaaattgtaaggccttgagtattctgatctctacctatcatttaatatatgggagttttatgtattagaaaaagatctagatttacattgcagagatgagaaaattcaaaccatgtagtgacttaaaaatattttttctaaattataaaatataagttcaaagggaccaaaatctgtgagaaaagagtttgaataaattttggtttagtttcctgactaaaacattagacaaaaccacaaattatggaagaaatccccttgaaagttacatttaggagagaaaattttctgaacctagattcatttcaatgttaagggacttgtttcttgtttctaatattaccttgagtgacatttctatctaaaattgacacttataatatctaattttatttgcttctaggtgagttcttggatgaagtgcatccttatagcttctggggactaatctcaagtcatctgaatttattaacaaatccatgatctgagataaatgactctctagattcatgctatagttatttgataagtgttgactatcattaacccaaaaagccacattttggaggagcacaaacttcttgtagaattaatatgatattaacataaaatgcttcattttatggggtctggttcagaaatgcattgctctcccatctccgtgatcaaattggaccataagttacatgctgggctgctttttgttgctttgggatgctggtacgctattatctcactgctaatggtagccttagtggcttcccccggtgttccttccaaagtttccaggccattgttttaaaaatatgttttggtcttttatagcaagtggttgttaacatgttgtttgtataatagagaggaagtggaacttcacagtctttactggtggagagccattttcagttgccgctttgcttattaacaagaaaagatcttaatagtttctgagaaaattcagtcccttttactcaacttacaatctctgtggggtttatagagaatcttttacagagaatgaaaatctgtgtttaaaagaatgtaaagaggttatgtgtgggattataaatggtatttaagtacatattaggcatgctttcacatttatgtttatacagaattcaaaaaaatagtgcattcagtttgctgtatcccattcaaatatttatcccttcgtgattaattacagttacagaaatgactacatagtttaaaaggttaaaaatgaagaaagattgtcctacggatttttggtactagttctttgcatgtctggtagaatttggctgtgacttcatcatgcccatagctcttttctggatggtagggtttttttattagtgtttcaattttagaacttgttattggttggttcagtggttcagttactttctggctcaataatgggaggttgggtgtttccaggagtttacccatttcttttagtttttgcagtttgtgtgcttataagagttgataattgtttgaggatttttttttttttttgctatggggttaattataatgtagctttgttgtttctgatgtgcttatttggatcttcttttttttcctttgttattcaagctagtagtctattcttatttattctttcagaaaacaaattttggttttattgattttttgtattttaatgtttcaattttcagttcttctcgaattttggttatttattttcttctgctagattttggtttactcttgtttttctagttcctctgggtgtgacattaggttcttaatttgagatccttctatcttcttgatgtaggtgtttagtgcttgatatggtttggctgtgtcctcatccaaatctcatcttgaattgtaaatcccgggtgttgagggagagatgtggtgggaagtgatttgattatgggggcagtttcccctatgctgttcttgtgatagtgagcaaatattcagatatgatggttttataaatggtagtatttttccgcactcacacacacttgttctctctcgcctgccaccatgtaagacgtgcctcttccccttctgccatgactgtaagtttggcctccccaaccatgtggaagtgtgagtcaattaaacctctcttctttataaattacccagcttcaggtatgtcttgatagcagtgtgaaaatggactaatacggtactgtaagcttttctcttaatactgatttcgctgtttctcaaggattctgttatatcacgtctttttaattaatttcaaataattttttgatttctgccttaattttgttctttacgcaaaagtcattgaagaaaaagttgtttcacttccatgtaattgtatgattttgagagatcctcttggaattgctttctatttttttattgcactgtggtgtgagagtgtgcttattgtgattttattttattttttgaaatttgttgagacttgctttatagccaagcatgtggttggtcttagaataggtgccatgagtagataagaagagtgtatattctgtgtttgttgggtgtagtatcctaaagatatctactgggtccgattggtcaagtgttgagtttaagttcagaaatatatttgctagttttctgccttgacgatctaatgccagcacctgttattttttgactttataataatgaccattcagactggtgtgagacggtatcacattgtggctttgatgtgcatttctctaatgatcagtgatgtagagctttttttcatatgattgttggtcacctatatgtcttcttttgaaaagtgtctattcatatcctttgcccactttttaaagaggttgttaggtgttttttaataaatctgtttaagttccttatagattctggattttagaactttgtctaaatgttttttcccattttgtaggttgtctgtgctgttgatagtgttgtttgctgtgcataagcacttttgtttaattagattccatttctcaattttttcttttattctaattgcttttggcatctttgtcatgaaacatttgcctgtgactatttcctgaatgatattgctaggtttacttccaaggtttttatagttttgggttttatatttacgtctttaatctatcttgagttattttttgtatcttgtgtaaggaaggggtccagtttaaatcttgtccatatggctagccagttatcttagcactatttattgaaaagggaatcatttctccattgcttgtttttgtcaggtttgtcaaagatcagatagttgtaggtatgtagtcttatttctgagttctctatcctgttccattggtctctgtgtctgtttttgtaccagtgccatgttgttttggttactgtagccctatagtatagattgaagtcaggtgggatgatgcctccaggtttgttccttttgcttaggattgccttggctattttggctctttgttggttccatatgaattttaaaatagtttttctggttctatacattgctttgaaaagtgtggccatttaaacaatattgattctttttatgaatgagcatggaatattttttcatttgtttgtgtcatctctgatttcctttagcactggtctgtagttgtccttatagagatctttcaccttccttgttagctgtattcctaagtattctattcattttgtgtccattgcgaatggtcgtacattcttgattgggctcttagcttgactgtttttggtgtataaaaatgctagtgatgtttgcacattgatttttatatcttaagactttgctgaagttgtttgttagcttaagaaactttttgactgagactatggggttttcttgatataggatcattttgcctgcaaacagggatagtttgacttcttctcttcctatttggatgccccctaatttcttgctcttgtctgattgccctggtgagcacttccaatgctatgttgaatacgagtagtgagagagggaatctttgtcttgtgctggttttcaagggaagttcttccagctttttcccattcactttatgttggttgtgggtttgtcaaagatggctttttgaattttcagcattcttgtgctgattctttctcatctttgtgggcttatctaccttcaatctttgagatcgctgacctttggatgggtttttcttttattttctcctatttgattatcttgagtgcgtgattgtggcataaggttgattcagccaactggctttgtttctgggagatgttagaaggcaaacactcagttcccaactcctgggctgtgtgctctaactctgggggacttgtatcgagccccgactttgttctctggctccttgaggtttggagtccactgcgctggcagtcctaaggtgcagcagcttcagcagagtgttagtggatgtaggggtggctgcgtcactgcaggcattaaccacagtggcacaagcaaggcagctgaggggggcaaggggcgccttctggatactgtgcgctcttgaactggaggtgatgttgccttggggctgggtgctggccagtacaggtctgggtgccttctctgtgcctcacaaacaggagtgatccctcagggtgtgagaggatcctctgttctcttcaaagtgttagcacgagggctggatgctggtggaggtagggctggatgctggtggaggtagggcttgctggttctgtgcctgccaagactccaactgcagtggtggtcctgggggacagagggaggagactacactcatgtgtgctgatgggacaggtgaaaaaaaacccactcttgcagacacgcaccagctgcagtatggggagggtacatctggggtggtgcacagccctaggggccgccttgctggagctctacgctggtaaggcatagcctgccagcatggaagctatggtgtgggccactagggcactcaagactgacctgtaagcaggtgtggccaggctggggccctgggaagaccaatagaccaagaagtgctcaggtcggaccaggcccgttggatgagcaagaccgctctgcagagattgggtctgacagttcccctagggctaaagtctcctatgggagcaagtcaagcctatagggatggctatcgctggccatgctcaactacagacactcctgcaccaaaccctctacatcagtggccttgctgttccaccagttctctaagtagttctccctaccacctcaagtgtccatggtggacgatgggtctccttcgcaggcttccagaggcctgtgatgagagtgggttgctccttgccagttcaactcaccctttctcctgaggtggttgtggttcaaaaatgaatcccagtgtgtggcagcccatgcagggtttccaactttctcccccttaatcccagctcctgtgtctttcctctgtccactttcagtgccttccctctgaagatctgttgaaaggacaccagttgcctcagtctctccatgggaggtcttccacttgtctgtgtctagctgaccatctttccttcccccctactttcttgaggcacagagttaagttgtttatctgaaatccttcttctttttcaatggttgtagttactgctgttagtgtccctcatagtactgcttttgctgcattccataacttttggtatgttttatttatttttgttttcattagtctcaagatgttttctaattatttttgtgatttcattttgtacatttgttgttcaaaagtgtgttgattaatttctatatatatgtgaattttccaagtttcaactattgatttctagtttcatttcactgtgtttggaaaaggtacttgttacgatttcggtcttcttaatttgttaagatttgctttgtgacctaccatgtgatctatcctggaagatgtttcatttgctattgagatgaatgtgtattctgttgctgctcagtgtaatatgtcttttgacctattaatatttttcaatcctttatttcctcattaaactgtttttttatttccattatttaatttttggtttgaaatactctattattgttttactatttcttcatttaattatgttaatgtttatatatttgggttctcttatgttaagtgcatatataattgttatatattctcagataaatggcccttttatcgttatattcttgtaagagttttcacttaaagtactttttgtctaataagtatggcaacctgtactctcttttgatgctatttgcatgcaacaactttttcccttttactttcagtctatgtgtgtccttcaatctaaagtgagtatcttatagacagcatatagtttgatattgttttattcttttcctatcaatcaaccactctacctcttttgattggagagtttaatacatttacatgtaaaggaattactgatagggaaggacttgctgcattcattttggtactgtttactttcttgacatagctattttcttctcctcttattctcttgctgccttcctttgtgttttgttgatattttgtagtgatatctttccagtattttctcattttctgttctatgccatctgtgagtattttctttgaggtttccaggaacttataaaaaacattttatacttatgacaatttgttttcagctgataactatgtaactacatcagtgtacagaaactctgccattttacgtctcccccactttgtgttattaacatcacaaattacatatttttactttttgtattcaataacatagttttatagttataataattttatacttcataagtttgatgacagaaataaaactgatttgcacacatatatttatgacatacaacatgttgtttcaatatacatatacggtgtgaaatgattatcaaaatcaatcaaattaatgcagtaatcacctcacagttacctttttttcttttttgtagtgaggacacttgagatctactctcttagcaaatttcaagtgtacaatacattattgttaaatattgttaccatgctgtacattagatctccaaaacttataatagaaaatacatataatttaacaacgtctaccagtttacccaccccctgacacttggcaagcacccctctactctgtttatatgagattgactttatttatttatttattgttttgagacagagtctcgctccatagcccaggcttgagtgcagtggcatgatcttagctcgctgcaacctctgcctcccaggttcaagtgattctactgcctcagcctcactagtagctgggattataggcctgtgccaccacacccagctaattttttgtatttttagtagagatggggtttcaccacgttggccaggctgctctctaactcctgacctcaagtgatctgcccacctcggcctcccaaatttctgggattacaggcatgaaccaccatgcccagcaaagtttgactttattaggttccatgtatcagtgagatcatgcattgtttgtctttctgtagtggcttatttcacttaacataaaataccccagtttcattcatattgtcgcaaatggcatggttttcttatttttatggctgaataacaatgactaattatatatatatatatataaacatatataaacattctatttatttatctgtagaaagatgcttaggttgttttcatatcttagctattttgaatgacatggtttggatgttttgtctctccaaatttcatgttcacatatgacctccaatgttggaggtgggcttagtgggaagtgtttgggtcttggcagtagatcccttatgaatgtcttggcaccatcctcatggttatgagtgagttctcctcctggtagctcatgtgagagctggttgtttaaaatgagtgtggcgctttcccccctcactcttgctcccctctctcttttgctcccactttcaccatttgatgtacctgcttccccttcaccttcttcctccatgagtgaaagtttcctgaggcctcactaagagaaaatgctggtgccatgctttctgtacagcctagagaatgacaagccaaaacaaaaactttaatttttacctacatttattgagtctcttcggtctggtagaacataactgaacctagtcatttctgtagaactgttaactcagtaattttttttttttttgaggtggagtttcactcttgtcacccaggctggagtgcaatggtgcgatctctgctccctgcaacctcgccgcctaggttcaagcgattctcctacctcagcttcctgagtaactgggattgcaggcacccgccaccacgcccagctaatttttatatttttagtagaggtggggtttcaccatgttgaccacgctggtctcaaactcttgacttcaggtgatccacctgcctcggcctcccaaagtgctgggattacagacatgagccactgcgcccggcaactccgtaatttttaaattcaatccataattttctacattaggaaaggttttacattccctctccttttttttctaaggtggtatttaactacaggtgtagatgacaggctcatttagaatcaaagatgtattcagagaggaattatctgattctagattgtcatgtgtccatctcatgtatcctttgcaataaatatcgttctgtattgctctcagctgtaatcatttttcatcctgatattacctaagatagtcatgctatctctgaaatcgtagttgtaagattaatgctgttttctactacaacatgacattatttcaacaatgagatccttagaatctaccacctaacttccttgcttgtttcaaatccttttttttttctttgcttacttttatgcctttcctgggagcagagaaaaatcttgcttctctcttctgtcacgctgcagccacaaaaagcttcacaaactgtctcagagcaaactgatctttctagtaaaacttgacctctttgcctaatttgtctgctgttacacgatgctgaagtgtagtaaaggctggagtcttgaagatctctaagtcatatgataaacaaagcacagatttctactctttgtaaattgtattctatttggaagttctattcccctcaccttcctcaaaacttgaatgtgctttaagtgaggcataattcaagatccttttaagaaacactctccagcatctaatatgtatgtttcttttcttactcagcctctgccccctcttgccaagccaagcagttttagtgaaatgtctgccgtggcctcccttccattggacagtggcagccaaagactagcttgagtagtgaccaacaatttgggagacaaagttattgcaggtagatgtgcacagacacatgcacacataggtaaatatttcaaaaaataactttgtcacagctaaccctattctaatattgctatggaacatacaatatgataaacacatagtacatattcagtatgtttgtgaatttaaaaatgtattggttctgctctcttcaagacagagatattacatttgaattcatgtaagttcatttttttgcattgatttactatgaattaaaagtaaaacaaataaggaatgtataccagagaaatcgtcaacaccttgggagatactaagatggatttacatgtaaaatctgccctcaatgagtttatatgctaataggaagagacatatttgttcataaataactctaacacaaagcagattgtgtgccataataataagacatattaatagctacaatttattagactttaatatctgccaagctccatgcttggtacttcatatacattaacttatttattgcacataacaactagtgatgttgttgttatcatttcagtagaaataaaaaatcagagaaagataagattaacatgagtggggtgggattaagaccttcctcattaatgaagcaacatttaaactaggtctttattaaaatgggtgggaaacttagaggtgtatttggagaatacaatgttattggcatcaaaataacaagagatttgtgaggggttaatatgattaggaatgtactttgaagagatttctgatagaagtttgaagatcagagagtaaaaataactctctcatcaagaagaataaaattaaatgttaaatgcatctttaatgaataattggcacattaactgaaaattgcagattttaataactctataaattcttataacttaagcaagtctacaaatccatagtccagttatgcatcagtgctcaaggtacagtgaaattagaagccaatgacatgtatgtccccttttaaaaagccggatatttaaatgtcttttgctatcaaacacataaaaatcttcaaaaatgccattatttgataattacattatatctattaagtaatgagtatttgatgactatatttcaatccttgaaaaaagaaagaaactatagttatctaataatgtgattgattcacctaatccaagggacctctcttttgaatgaatcctataattatttatggtctttaatcgagcttacatagacaccaatttttgtcacctcaactttatgttataaatgtgttaatagataagaatctggagcaaaataaaaagatcaaagattttacaagtctaggcgataaaatttgatctgaactaaaaatcaaatttaaaaggcactcttttaagcaatgtttctgtccattatagctgagatttaataattaattactgatgtctccataattttctgataagattatggggctaataaaagcaaaattacatatttttgtaattgtataagtcgattagctttccacagataaacacaccatcttttctcagtgctattgatgaaaattatgctcaacaaaccactgatttcattagatattgataggaattatgttagaaagagattctctggacaacttagtttgagaaagtactaacttcaaaattactgcgaattacttcaaaataccaacttcagattttcattttgttttgtttttattataaactttctcttcacgtttaaaatgcccatatgcactgcaaatttctaagaaaataatatagtatgtagtatttcttaaaattatatcacagaatcctttattatgtaaactttttacccaaatattaagctataaaatatatttgaatattccgctgtatgccatacaataaaaattcttgtaatatgtgttttttaaaaatttttattataagttccagggtacatgtgcaggatgtgcaggtttgttacataggtaaacgtgtgccatggtggtttgctgcacctatcaacccatcacctaagtattaagcccagcatgcattagctatttttctcgatgctctccctccctcaacctcacctaccaacaggcccaagtgtgtgttgttaccctccctgagtccatgtgttctcattgttcagctctcaggtataagtgagaagatgcagtgtttggttttctgttcccgtgttagtttgctgaggataatgacttccagctccatcaatgtccctgcaaagcacatgatcttatttctttttatggctgcatagtattctttggtgtatctgtaccatatgttctttatccagtctatcactgatggacatttgggttgattccatgtctttgctgttgtgagtaatgctgcaaagaacatatgtgtgcacatatctttataatataatgatttatattcctttggatatatacacaataataggattgctgggttaaatgatatttcttgttctagatcttagaggaatcatcacaccatcttccacagtggttaagttgattcacattcccaccaacagtgtaaaagcattcctatttctctgcaaccttgccagcctctgttatttcttgactttttaataatcaccattctaactggcataagatgatatctcatttttgttttgatttgcatttctctaatgatcagtgatgttgagctttttttcatatgtttgttgaccacatgaatgtcttcttttaagtagtgtctgttcatgtcctttgcttactttttaataggcttgttttttttcttgtaaatttgtgtaagttccttgtagattctggatattagacctttgtccaatggatagactgcaaagattttctccattctgtaggttacctgtttgccctgatgacagtttcttttgctgtgcagaagttctttaattagatcccatttgtcaatttttgcttttgttgcaattgcttttggtgatttcatcatgaaatatttgcccgtgcctatgtcctgaattgcctagattttcttctaaggtttttatagttttgggtcttacatttaagtctttaatccatcttgagttaattttcatataaggtgtcaggaaggggtccagtttcaattttctgcatatggttagccacttctcctagcaccatttattaaatagggaatcctttccccattgcttgtttttgtcagtttcgtcaaagatcagatgattgtcgatgtgcagttttatttgtagtttctctattctattccattggtctacattcctgtttttgtaccagtaccatgatgttttgtttattgaagccttggagtgtggtttgaagtttggtagtgtgatgcctccagctttcttctttttgcttaagattgtcggggctatatgagctcttttttggttccataggaatattaaaatagtttcttctagttctgtgaagaatgtcaatggtagtttaatgggaatagccttgaatctataaattactttgggcagtatggccattttcacaatattgattcttcctatccatgagcatggaatgtttttccattcgtttgtgccctctctgattttcttgagcagttatttgtaattctccttgaagaggtccgttacttcccttgttagctgtattcctaggtagtttattctctttgtagcaattgtgaatgggagttcattcattatttggctctctgcttgcctgttgttggtgcataggaatgcttgtgacttttgcacattgattttgtatcctgagactgctgaggttgcttatcagcttaagaaccttttgggctgagatggtggggttttctagatataggatcatgtcatctgcaaacaaagacaatttgacttcctcttttcctatttgaataccctttagttctgtctcttgccttatttctctggccagcactttcaatactgtgttgaataggagtgttgagagagggcatccttgtcttgtgctggttttcaaagggaacgcttcctgcttttccccattcagtatgatattggctgtgggtttgtcataaatggctcttattattttgaggtatgtttcttcaatacctagtttattgagagtttttaacataaagggatgttgaattttattgaaggtctttcctgtgtctattgagataatcatgtggtttttgtcttttgttctgtttatatgatggattatgtttattgatttttgcatatgttcaaccagccttgcatcccacagatgaagccaacttgatcgtggtggatacgctttttgatgtgctgctgtattcagtttgtccatattttattgataatttttacattgatattcatcagagatattggcctaaagtttcctttttgttcttgttgtatctctgccaggttttggtgtcagggtgatgctggcctcatagaatgagttagagagaagtccctccttttcaattgtttggaatagtttcagaaggaagggtataaggctcctctttgtatgactggtagaattcaggtgtaaatccatctggtcctgggctttctttggattggtaagctatttattactgccttaatttcagaaattgttactggtctattcagggatctaacgtcttcctggtttagtcttgggagggtgtatgtgtccaggaatttatccacttcttctagattttctagtttatttgcatagaggtgtttatagtaatctctgatggttgtttgtatttctgtggggtcagtgctgatatcccctttatcattttttattgttgtgtctatttgattcttcccttttttccttatcattagtctagctagtggtctatttattaatattttccaaaaaccagcttctggattcattgatttttttggaagggttttttgtgtctctgtctccttcagttccgctctgacgttggttatttcctttcttctgctagctttggagtttcattgctcttggttctctagttcttgcagttgtgatgttaaggggtcaatttgaggttttctaggtttttatatgggcatttagtgctataaatttccctcttgacactgctttagctgcatcccagagattttggtatgttgtcacttcattctcattggtttcaaagaacttcttgatttctgcctcaatttcattatttatccaggagtcatgcaggaacaggttgttcagtttccatgttatggtatggttttgagtgagtttcttaatcttgagttctaatttgattgtgctgtggtctgagagactgttatgacttcagttcttttgcatttgctgaggaatgatttacttccaactatgtgatcaattttagagtaagtgccatgtagtgtcgagaagaatgtatattctgttgggtggacaattctgtagaaatctatcaggtccacttgatccagagctgagttaaagtcttgaatatctttattaattttcagtctcaatgatgtaatattgacagtggggtgttaaagtctcccactattattgtgtgggagtctaagtctctttgtagatctctaagaatttgttttatgaatctgggtactcctgtattggattcatatatatttaggatagttagatcttctcgttgaatttaacccctttatcattatgtaatgataatttatctttgttggtttaatgtctgtttcatcagaaactaggtttgcaacccctgcttttttctgcttttcatttcttggtaaatttttctacttccttttattttgagtctatgtgtgtctttgcttgtgagatgggtctcttgaatacagcatgcctatggatcttgatgctttatccagctttccattctgtgtcttttaatttggacatttagcccatttacctttaaggttaatattgttatatgtgaatttgatcctgtcatcgtgatgctagctggttattttacagacctctttatgtaggtgcttcatagtgtaactggtctgtatacttcagtgtgtttctgtagtggctggttactttttttttaaacatatttagtgcttccttcaggagcttgtgcaaggcaggcctggtgttgatgaattccctcaacatttggttgtctgaaaaagattttatctctcctttgcttctgaagtttagtttggccagatatgaaattctagacttaaatttttttcctttaaaaacgttaaatatagccaccaccccccccatttcttatgacttgtagggtttctgctgagaggtctgctgttggtctgatgggcttctatttatgggtgacctgggctttctctctagctgtccttaacattttttgcattcattttgaccttggataatctgatgattatgtgtattggggttgatattctcatggagtatcttaccggagttctctggatttcctgaatttgaatgttggcttcttgtgctaggttggggaaattctctggaataatatcctgaagtgtgttttccaacttggttccattcttcacatctctttcaagtacccctatcagtcgtaggtttggtcttttaacataatcccatagttcttggaggttttgtttgttcttttatattatcctttttctctaattttgtgtgcctgccttatttcagcaaaatagtcttcaagctctgatatcctttcttccacctggtctattgagctattaacagaagttacatagttatactagtgtttgcattgtgaaggtctcatgttgtgtttttctgctccatcaggtcattcatgttcctctctaaactggttattctggttaatagctcctgtatgttctagttaatagcttctgtaatgtcttatcgtggttcttagcttcttgcaatgagttataacatactcctttagttcagtgaagtttgttattacccatcttctgaatcctacttctttcaatgtatccatctcagcctcagcccagttctgtgcccttgctggaaatgtgttgagatcacttggagaagaggcactctggctttttgagtttttagcatttttgctttgatttttttctcatcttcatgggtttatctacctttaatctttgaggctgccgacctttggatagggtttttgtggggtcttttttgttgatttcatggttattgttgttgttttctgtttgtttttcttttagcagtcaggcccctcttccatagggctgctgcagtttgctgggggtccactccagaccctattcacctgggtccctcctgcaactggaagtatcaccagtggaggctgcagaccatcaaagatggcagcctgatccctcctctgtcccagaggggcaccgacctgatgccagccagaatgaacctgtatgaggtgtctggagactcccattgggaggtctcacccagtcaggaggagcaggatcagggacccacctaaataagcagtccggctgcccctcggcagagcaggtgtgctgctctggggggattccccctcgtccaacctgttctgactctcaaaaaccagcaggcagaaaagattaagacgattgatccacgataccatagccatccctcctcctaggtgctcctctcagggatatcagagttctgtccataaacccctggctggggatgctgaaattcctgtagggaggccccgcccagtgagaaagagtggattggggtcccacctaaagaaatattctggccactacctgcttcagatactgtgctatgctgtggggaattgctcctggtccatactggccagtctcgctggcaccagcagtaggggaaaaaggccaactggagccgcagtgattgcgactgtctctctcccccaggaactaagtcttcttaggcaatctccagcctgctgtgctggccagttgggattccaagccagtgagttttaccttgtggggctccatgggagtgaggctgcttggcttcctggcttcagcccccttcccactggagtggatggatctcttgccttactagagttcccagagccagagtatgcaaatactcctgtgtctcagtgcctgctcgagtttctgcccacttgcgcagcctctgtgagtctgcacagcagtgttcttgggatccaaggccctggtggcgtgggctcacgtggggacctcctgatcctcaggttgcaaggatccgtgggaaaagcatgatcttcagggaggctagcacaatccctcaccacctcccttagctggaggagggagctccctttgcgctgtgtagctctcgggtgggccctcactccaccctgctttttattgctctctgtgggtcacgccaaccacctagtcagtcccaatgagagaaccttggtacctcaattgaagatgcagaattcactcgcagttttcatccttcttggtgggaggtgcagagcagagctgtttctatttggccatcttggctgctcccctccatatgtgttgtttttatgttcagattcaaataatcctaatacatggggaaaaattaatgatttctttctctatgtgtatctggttggctactttattcaaataatacttagatggatgctgattggacacatttcataagccaatggctatttgctgcatggtgacagtttagtttctgtttccctgaagtcggagatttaaacgcaaagaatttacttgggtgggacagggaacaccagcagaggcattgatgtgtaagacagggaaggcaaggcagctgataatgagtatgttcttaagccagttaccacaatggacaaccaaatattaatcttgcaagcaaatcctgtaaaacttttcaaaaatgcatgctttcacattatcccagctatgggatgctggaactgtgatgttcatacctgcacaccaaccagtcatttgttaagggccgtccttgggagttaggagtgggttggggaggtgataagggagattgttttctaggcacttctgggcaaaatggtctctggcagtactactcaagacattatctgttaacagaacatgtttaccaattatgggaatagctttccaaattgccagtgcatatgaagtggtgaatagattgcaaggaatcatctaataatagattaatggggcttgagaacaagatggtgaattgggcatgcatttcttacctcctattgcattgaattttcaagacatggggaaaaagagccttgcaagggaaaaagtcattaaagcagtggaaaataagaaatggtaccaccagtagtctagaaatgttgagagacttctaacaagaggaaagtaggtagaatggcattggcaaagaaaattagatcccaaaatatgcagagaggcttcttataggtaagaatggttctgtggaagctctaagcatggggtcacttcatgaagaaatggaagagagtcttgaagtgtatatcagggtgattaattagaaaactttggagcagcaaagttttttttttttttcctctccacttcttttatttgtgttgaatacttggcagaaggccatgagtattagtcctgaggctgagaatgaacagcagagctcatattgcctttagacacccagaagaggcggggaatctctgacagtcagaggacaactgtatcaggaacatgttccctttcccttcactctgccagagcagaccgtggtaaacagattaggcaggagatggagacagaagtgctcaaaacaattctgagcacaccaacatgaactatcaaatatctgagggaaataaatatcatagaaagcaaaatgctaaaattaagcaacaggagatttaacactcccctccttcaccagatgagggggaggggagacacttaatatggtgtggttgaagagtagaatgttctctgataattggtgaattaccaagtaatattgaaccaaataattctttaccaaagcaagtgaaatgggtacatgctggaacataagagggaaaaccgaaccttggtgaaaagagatccagatatactattgttattctaggtagatttccagagagagaggttaaaataaatgtaaagaggaaaagtaactaaatcatggaagaaaatttcccagacttactgctgaccaccggcaagttggatggcaaaaaggataaatgttaactatccacacgtagacacatagtgatgaaatgttagaacagtgacgataaagataaaaacctttaaatggtttcacacagaaaaatgaaacaaaaacaaagcaaaaacatgcagagtctccacaaaagagaatgagtcatatcactgtcacacttattatctacaacatcaggtaaaaaacgtggagcaggaatacttgatattaaataatagcatcaagaaaggctcatcaacattaaatacaactgatttgttaggaaagagaagtaaaattcatcaaatgcctaacggattaaaacttttgtaatatgattttatctcacctagaggtagataaggcatagagatactaattactcaaagcaagacagaagttatgagtagatgtatgatacaaactcatgtcttttagatgctatgagctcttgtcctatccattgctatattctttgtatttctttttattattattcaaaaaatatttgtgggtacatagtaggtgtatatatttatgaggtacatgacatgttttggtacaggcatgcaatgtgaaatatgcacatcatggaaaatggggtatccatcccctcaagcatttctcctttctgttaaaagcaatctaattacattctttgttatttaaaattatacaattaagttattattgacttattgctaccctattgtgctgtcaaatagtaggccttattcattctttctatttttttgtttttgtatccatgaaccaaacctacccccatctcccacccagcctccactacccttcccagcctctggtaaccatccttctactctctgtgtccatgagttcaattgatttgatatttagatcccacaaataagtgagaacatgaggtgtttgtttttctatgcctgacttatttcacttaatgtaatgatctccagttctatccatattgtagcaaaagactggatctcattctttttatgactgaatagtactccacatttttctttatgcattcatctgttgatagacacttaggttgctttggaattttagctattgtaaatagtgcagcaacaagcataggagtgcagatatctcttcaatatactgattttctttttcgggggtatatacccagcagtgggattgctggattttatggtagctcaatttttagtttttggaggaacctccaaactgttctccatagtgattgtactaatttacattcccactaacggtgtaccagggttcccttttctccacattctcaccagcatttgttattgcttgtcttttggaagccattttaactagggtgagatgatatctcattgcagttttgatttgcatttccctaatgatcagtgatgctgagcaccttttcctatgcttgtttgccatttgtatgtcttcttttgagaaaggtttattcaaatcttttgcccatttttaatcagattagtagattttttttcctatagagttgtttgagctccctatatatattggctattaatcctttggcagagaggtagtttgaaaatattttctcccattctgtgaattgtcttttcacttttttgattgtatcctttgctgtgaagaagctttttaacttgatgtgatcccatttgtccatgtttgctttggttgcctgtgcttatggggtattgctcaagaagtctttgcctagaccaatgtcctggagattttacccaaagttttcttgtaatagtttcatagtttgaggtcttaaaattaagtctttaatccattttggtttcatttttgtatatgtcaagaggtaggggtctagtttcactcttttgcatatggatatccagttttcctagcaccatttattgaagagactgtcttttccctagtgtatgttgttagcagctttgtcaaaaatgagttcagccaggggcggtggctcatgcctgtaatcccagcgctttgggaggccgaggcaggcagatcacgaggtcgggagttcgagaccagcctggccaacgtggtgaaacctcgtctctaataaaaatacaaaaaattagccgggcgtggtggcagatgcctgtaatcctagctactggggaggctgaggcaggagaatcacttgaacccgggaggcagaagttacagtgagccgagaccatgccactgcattccagcctggacaacagagcaaggctctgtccccaaaaaaaaaaaaaaaaaaaaaaaaaaagagttccctgtaggtgggtgaatttgtttctgagttctctattctgctccatgggtctatgtgtatgtttttatgtcagtacaatgctattttggttactacagctctgttatataatttggagtcatgtaatgtgatttcttcaattttattctttttgcttaggataactttggctattctgggtcttctatgattccatataaattgtaggattgtttttctttatttatgtgaagaatgtcattggtatattgatagacattgcattgaatctgtggattaccttgtacagtatggacattttaactatattcactcttgcgatccatgaacatgaaatatctttccatatttttggtttcctcttcaattttctacatcagtgttttatagttttaatatagaaatctttcatttctttggctaattcctagatatttatgtgtggctattgtaaatgggactactttttaaatttctttttcacattgttcagtgttggcatatataaatgatactgatttttgtatattggttttgtatcctgcaactttactgaattagtttgtcagatctaataattttcttgtggagcctttaggtttttccaaatataagatcatatcactagcaaatagagataatttcaattcttcccttataatttgaatgccccttatttatttctcttgtctgattgctttagctaggatttacagtagtatgttgaataacagctgtgacagtgggcatccttgttgtgttccagatcacgaagaaaggctttcattttttctctattgagtatgacactagctgtgagtctgttttatatggattttattatgtgggtgttcgttctttctagtcccaatttttttgtgggtttttatcgtgaagggatgttggattttatcaaatgctttttcagcatcccttgaaataatcatatggtttttatctttcattctgttaatatgatgtatcacactgtttgatttgcatatgttgacatatacttgcatcacagggataaatcccagttggtgatgatgaatgatctttccaatatagttttgaatttggtttgctagtattttgttgaggattttgcattaatattcatgaaaagtattggcctgtaatttttttctcctcctctgtttttttggaataatttgagtagaattgatattaggagttctttaaatgtttggtagaatgaatcattgaagccatcaggtcctgaccttttctttactgggaaactttgtattacagcttcaatttccttacttgttattggtctgttcaggttttggatttcttcctaattaaatattggtaggttgtatgtatctaggaatttgtcaatccattctatattttccaatttatttgcatatacttgctcataggggccactaatgatcctctgaatttctgcagtatcagttgtaatgtctcctttttcatatctgattttatttggattttctttgttttttcttagtctggctaaagttttaccaattttgtttagcttttcagaaaaccaatttttttcattgatattttgtattttttaaaatttcactttcatttatttctgctctgagcttcattattttatttttcttttactaatttggggtttggtttgctcttgcttttctaattctttaagatttttagttagactgtttatttgtattttttcctcctttttgatgtagacacttaaagctataaacttacctcttagtacttcttttgctgtatcccataggttttggagtgttgtgtttccgttataatttgtttcaagaaaatttgcaatttccttattaatttcttcactgacccactggtcattcaagagcatattttttaatttcagtgtttttgtatagtttccaaaattcctcttgttcttaatttctagttttcttccattgtggttagagaagatgcttaatattatttcaatgtttctgaatgtttttaagacttgttttgtgacctaacatatggtcgatccttgagaatgatccatgtgcttaggaaaagattttgtattctgcagctcttggatgaaatatcctgtaaatatcaattagattaatttcgtctgtagcgcagatgaagtctgattttttttattgattttctgtctggaagatctgtccaatgctgaaagtgatatgttgaagtctccaactattattgtgtcagggtctatctctctctctttagctctaataatatttcctttgcatagcaatcaagcaagacccccatctcaaaaaaaaaaaaaaagaaagaaaaagaaaagaaaagaaaaaaaagcaacagcagccatgaggatatttggaagaaaatttgacacatgagtgctgttggtaataactttgtaaaaattacacaagccatggagcatgttgttatgacaattccagactgaaatatgagcgtaagacaacatagttatatcaactgtgacaagcttccaatttgctgttattacattgaatttcacgtgcttgcattaacatcagaaatacagtataatatatattagatacacacatacacagatagttttaccacccccctcctaaaaaaaaggagaaatggaaaggcatttctatataaacaataaaataacaaaagcaacataataaaccaaagtacttgtaaagccacaacataagcaaggattgatgtcccccaatacacaggactgatatggttctgtaaagttgcagctgatgctaatagcatggcttggaagcagtcataatccagaatgcatacaaaggcataagaaattctcattctgaaagtgagtgcttaacccagaaacatagattacccaaggaagcacaatgccattggtagaaacactccagtaagtgttaacactcatactggcacactaggaatactagagtactctatactgacttaaatacatttaataccctcaataaacaaagggatcaagttcattgtattggttattagttagaaattacgaaaaaaaaatgaaccagggaacaataagtagacatttatgaagaataactattgtggtattttgaaaaaaaatgtgttgaaatacagtaaaaatattaacacaagttttttgctgaataaacacagccaaaaaataagttagtaggcagaaaggtcaggtgtagcagtattctgaaacagattttaaaatatatataaaaaagggaagccatgaaagagaagactggaaaaatatatagatcaccttaattttttaactaagatttctgaatgaaagggttgaaaactgatgggtccaaaataattgaaaaaatcataaataaaaattttccagaattgaaagtacgtatggatcctgatattggaataactcttttggtatatagcagggcaaatgaaaaaatgaaacttgtccagaatcttgtagtttcaattttgagtcacagataagaagaaatttctagaagttaaccacagtacactttcaaattcccctagagagtggttaaaaattctcaacaaatgtgtcaatattttccaagtatgaaattttgggcgattaatatacatgatggctggtgttggtgctcttacttttttctgtttctttcagagtagaaagtaatgtttaactacattaatcctatttaagatttcttttcaatcattatttaaaactgctatagcaattaaaggatgttttactgtttggtattatgtcatagatttgaaaattattgctgtaaaatatcatcagtgttttaatgaatggagagcatcgtctatgtgtattctgaattcttagtcttgctgcccacatgtattaaattgtatgagctattgagaagagaagaatctcataagtaaacaggaaaaccaggataatattcctataagcactctgatactatttttctccttgctacaaaatgtctttttctactttttaaagtgattcatatttattttttatgaaattatctatctttgaatctatatagtctatcaatatatttgaatatacaaaatcatctctgtggctactgttttatataatatccctcattttaattcatatattttaagttacctatgatttaaaacaactaatattggcattgaatttcaaaatctacagattttagtgtcagtttaatggaatatgcaagcagaggtcaacggcatgatctttttataaatatatatttaaataaactattatgtacgcttattttacataagattatattctctgaagttcatgtgacagctttcaaatgtagctaacatggattgtctttagatgaaattacatcttctttgtaagctatctgttccctttaccacgtatttaactactaagcatggagtaaaggggaaaagatacgagtcagtgtctaagtcaaggatataaaataaaatacctcctatctctgaaaagcttagactgcaaaatttgttgagcaaatatgcatagtgatttaacagtttaacttttcttccctcatatcagaacattcagctaatgtatttactatgagaatttctactgtttttatgagtggaagattgaggttaggttgaggtacaaaataaactacctaacaaaaaaatccgcaagcaaacaaagaattgtacttatctactgctcaaaatttgggaggaaaagagatgttatgtaccacagttaaaaatatatttctgtatatagccatgcccaagggcagtaacgatgtcttatttaaattattacccctgatgcctacaacatataattttgctacacagttgagtaagctgcctatataaactaaggtttaaaggaaagttcacagatacttaatagaattgatagttaaagtacaaataagactttatatgcctggttattttgtaatgtatctactctagagtattggaataaaaaacatgaaggacattggcctgcactcttcaaaactatcaaggtcatgaaagacagacctcttcctgattaaaggagacttaatagatacaatacctaaatgcatatgatttggatcctaaacaaggaaaacaaaaagattttttgttgttgttattctatttttttttttttttttgatatggagtctcgctctgtcgcccaggctggagtgcagtggcgcgatcttggctcactgcgagctccacctccggggttcacgccattctcctgcctcagcctcccgagtagctgggactacaggcgcccaccaccacgcccagctaattttctgcatttttagtagagacaaggtttcactgtgttagccaggatggtctccatctcctgaccttgtgatctgcctgccttggcctcccaaagtgctgggattacaggcatgagccaccgtgcccggcgtgttgttgttattcttttgcaataatggacatgaaattaattggtgaaatctgaaaaagtttttagatctaaataataatagtgtatcaaagttaatttcctgattttgataatgtcctatgacaagcttgtccaacctgccaccctccagccacgtgcagctcaggatgactttgaatgcggcccaacacaaatttttaaattttcttaaaaccttatgagttttttttttttttgagactcgtcagctatcattagtgttagtgtattttatatgtggcccaagacaattcttcttccagtgtggcccagggaagccaaaagattggacacccctgttatggctaagtgaaagaatttccttggttttttttaaaaaaaggaagcactgcaacatttagaaataaaaggcatcatgtctgcaacgtaagagtacacaggagaagacgtagtaacagattaacatttgaagaatctaggtgaatattatacaagaatcgtttgctctataattgcagcagttatgtaaatttgaattttttgaaggtgatgaattaagatacagactaaaagcacacttccaaaatggcaataacttataggtgagttcagtgaattggcagggaagggaacaatagaaagacagcttggaagattttcaatagcagctgtccatttagtagaacaaatcagcagttcctgcttttttctcaatgctgtggcattgttttcactggggctttaaagggaagtggctgcatgccagtttctgtgttctcatccagctgttcagacactaaaatgacttaagtaacaaaggctgaagtttgagaagccatgcagtttgcctccaagacaagtgaacatgttaacagaatatttacaaatttatttaaaatggcaatcattggtcctgagagatagggaagaaagcgttcttacttaactaagaaaatgatcagtaggtgaaatatccaagaggtgtttcttaatacatctctattctgctcctattttatcctgttatactgcagttccctgaattctcaaactcagaatttgacaaagtagaaaaaaattaagtgaatttacttgatgttttgaaaacaaaacacaaacagctttgcctagtacatgtataaagttattacatagtcgctatagattgactttccacctttcaaaataatagacaacaaaaatgaatctgaatttgtaaagcacatttaacctcctcaagctcttgaaataaagttattcattagcaatatctcaatgattaaattcaggataacatgggattttttgaaaaagtgtgaaagcaaatagaagcatttaatagctggtttactattttgtgttctgtggaagattatgtttcaatttaataaataatgaaaaagaacatttccttcctatttttaagtaaaaatatgagttgtattcgagcatggttgtggtgcacttcttttggagacttacttagttatttaacttgtaaatatccaggaaatctgaaaaactaaaataaaccaaatattttcattataagtagcataccatttgaatatttaaagtatgctacaaaaataacacgtaaggtgtacacttcttgttaagaagattaaaaaaagcaatgcttatagtcttccaactcactcatcatggggcttcattatttgaatttattcaaagagtaaacaagcaaaacctctcaaatctcattctgcataaatctgataatggttctgaccaattaaaacttaggtgaccaaaatagatcatctgtactttattatgtggagcacttcacagaataattatttgaaggataaataaaagttaactactctccattttcaaagctagcaaaaaccagttccattgtatgttttcaattaagcaacacaatttaccagaacccaaggatttttataagcagtttatctacccctaataatggactagacagtaaagtaacttgatctctgccttttgttttttttcttggccaaggaggtgatggtaagtaactctatttgcagtggtgtgagagccctcttttttctactgtaatgcagtgatttttgacttcacattattcctacatgataccttccatgctattctaatgtctatatataattttctgtaaactactttatcatagactgtatcatatgaggcatttacgaattatttcaagcttcaattctatggacggtcacttctaatggaaaatccacagtccaggatggtctatctggtgttttataaaaaaattcacactccagaggtggctaccacaagcccctgtgctatctgtatctccaccagtaccaagcattttgctgaatttcatcctaaatgtcaaaaggagttttaatcaattaaattaaaaattttataattggcatgattactttcattggtgaaattacaatttttcttattatttagtttggttataatatttttaagatatctccactgttaaaatgaataagatataataatgtaggaaggatcatacaaataatgtgattcagtaattctactactgggtatatatccaaaggatttgaagtcaggatcttaaagagatccccgctaccctatgtataatgcagcattattcataatagccaagatatagaatcaacctaagtgtctgtgtatatatgaatgcataaagaaaatgtggtgtatttacataaagtaatactatttactttaaaaaagatggaaatcctgtcatttgcaacaacgtatattaacctggagacattatgctaagttatataagccagacacagaaaaacaaatactgtatgatcttatatatggaatctaaaaatgttgaattcatagaaggaaacaatagagtggtgattaccagacctgggacttggggagattggagagagatattggtcaaaggatacaaaattttagttagatagtaggaagttcaagagacccatggtacagcatggtgactacaattaataacaatatactgtatgctggaaaattgctaagatatttggtgttctcaccacaaaaacgaaggataagtatgtgaggtagtggatatattaattagtttcatttagtcattccacaatgtatacatatgacaaaacatattgtacaccataaatatatgcgatttttgtcaagttatcattagaaaaagaaagccctgtatatgtttagcataaggcatgttcagaaaacaactgaaaagtctccaaactttcacctcaggctgaggcctaggctcattgcaatcctggatatgtgttaaggaagagcaccagcacagggacaatctgcaaatactgggagggtaatattgtttgttgttgttggtggtggtggtggggtgtgtatgtgtgtgtgtgtattttgttgtcatttttataaacttatattcaagaaaatctctgtcaaaactctagctgaacagagacttcggtgatgacttatgacaaggaacacatggatgcatacactggtccctgaaatagttgagtattatagccttcaacaataataacatcaaaacaataaaccctggaaaggaggggaatttgattccacagttatcacattataatacttaagtgcccattttcaacaagaaaataacaaagcatacaaagaaaatgaaaaacatgacccatacaaagaaacaaaatgaattaacagaaaccatctctgagtaagcacagaaattggacttattagacaaagacttttaaaatgtcttaaatatattcaaagtcttaaaggaaaacatggacaaacatgtaatgaaacttcggagaataacgtatgaacaatatgagattagcaattagaagatagaaatttttaaaaaataagcaaacaaattgtagaactgaaaagctcaatagctacaatgaaaaaacactagaggcactcaaaagtagatgtgagtagaaataagacagaatcagcaaacttgaagataggttaattgaaattatgcagtctgtagagtgaaatgaaaaaagaaatgaagaaaagtgtacaaaggctaaggaacctgtggaacactgtcaagtggaccaacatatgcattatgaaattctaaaaaagggtaaaagaggaagatataaaggggcagaaagaatatttgaaaaaatcatagtcaaaaactttccaaatttgttgatagatctagcttcatagtcaaaacccaaacttcactgagaattaaaacttttccccttttctgcttgtatcagtctcaaaaaaaaaaaagccacattgcaatatatgtccctttatcctttttgttcattcctttctttttttaagctacacagagcacttcttttcccttaactcacaggatatatttgctgaaccttttaggtttaggctcacaaatagaagggattaaaagggaaagggcatatgttttctagtttggcttttggcagatatactaagttggcatattttctcatagggtgttttaattaatgtgaacttgtgagagattcccctgctgggaatcttcagttgaaattcctacaaggtgaacttttttttttcttcaataagctttttactactccagccataaattttgagcattcagcagtccacccctttatatatttttaattgaattatttgggagttttattgctattgagttatttgtgttccttatatattctgtatattaacccattgtcaaatgcatagtttgcaaatactgtcctttatttttgtacattatctcttcactttgttgattgcttcctatgctgtgcagaacctttttagtttgatgtaatcctatttgtctgtttttgcttttgttgctggtgttattgaggtcttattgaaaaaatatccttcccagaccaatgttgtgaagcatttcctctatgttgtcttctagtagttttgtagttttagaccttaaatttcagcatttagctcacttgagttgatttctgtatacagtgagaaataaggatctagtttcattctcctgcatgtgaatattcagctttaccaggaccatttattgaagagacccttctttcaccaatgtgagttcttggtgccttttttaaagaatcatttagatataaatatgttaatttattgctgtgttctccatttcgttccattcatctatatgtctgtttttaaagcagtgccatactattatgttactatagctttgtagtatattttgaagctagatggtgtgatacctctaagctttgttcttgcttaagattgctttggctattcagggtattttatggttccacgcacatttcaggattttttttttttatttctgtgaggaatgtcatagttattttcatagggattgcattaaatctgtatattgctttgggtatttggacattttaacaatattagttcttctattccatgaacatgtaatatctttctatttatttgtgttctcttacatttctggcatcaatgctttatacttttcattgtaaagatctttcacttccttggttaaatttattactaagaatcttattttttgtagctattgtaaattggattcctttcttgatttttttcagatagtttgctattggcttatagaaatgctattgatttttgtatgtttatcttctattctgcaacttactgagtttattaagtctaacagttgttttctgtacagtctttaggattttctatatataagattatgccaactgcaaacaaggcaattctacttcttgctttccaatttgaattgtctttatttatttctcattcctaagtgcactggctaggacttccagaggcatgctgaataatagtgataaaagcggacattttgtcttgttccatatcttagagagaaagctttcaaattttccctgtttagtgcaatgttggttgtctgttgttgtatatgaccttcattgtgttgacatacattccttttatacctaatttgttgagagtttttatcatgaagggatatggaatttagtcaaatgctttttctgtgcctattgaaataatcataaggttcttgtctttgattattgtaatgtgatgtatcatattcgttaattttctttagtggttgttgaccattttgacttttaattatcatactagacatctgaaagattgtatatcagcattcgagtaatgaagtattctgaattttacaatgaatttacccataaaagtgaggtgtatactttcatatgtttgcgtgatagtaattattgtctttttgctcccacttttgacattccatttagcattttttgtaaggcttatttagtagtgatgactatttttccttcatttctgaaggaaagctttgttgggcataccatgctagccaggcaatttttttttccccagtacctttaatatagcatcccattctttcctggcctgcaaggtttctgctgagaaatctgctgatagtctaaggggaattttcttatatgtgacttgacactttactcttgctgttttttagaattttttctttgacttttgacaacgttattataatatgccttggagagggcttctttgacttgaatttatttcaaatcttttgagcttcgtgaatctggatgtccatatctctcccaaatcttgggtagtttttaggtattgttttgttaaatagtctttctgtgcacttcttcatctcttctccctttaaactccaaagatgcaaatatttgattgcttaataacgttccacacatcctgtaggctttatttgctccttttgattgtttttttttctttcttgctgactggcttatttgaaaagacttgtcttcaagttcagaaactcattattttgcttgatacagtctgctcttgaaagtctcaattgtatattttagttcattcattgaattctttagctctagtattcctgtttgtttcttttttggtcatagctgtctctttgttgaatttctcttttggatcccaaactgttcatctaatttagtttgtctgtctgtattatcttttatcgtaaatttccttgggtcattattttgaattcctttttaggaaactcataaatgtttatttttggagggtcaattataggaaatgtattgtgtttctttagtagtgtcctattcgctttcttttttatgtttcctgtatcactgtgttgatatctgtgcatctgatggaacagtaaccacttccagtctcatacagtgtctttcatggggaaagactcacctgcccatgtgttgtagggtgttggttgagcagggtattttggatttgcttctgggtgaatgccgtaatgtggtctccatccagtttcttcagctataggcaacatcagtgatgcctgagtgtgcctcagtgtgcctcagtggttcatgctgtaacagtgtttgtggctggtctacctactcagttactgctccttgatagtggggcactggtatagtctgtgttttggggatatttagggctggtcaacttgtgacttgggctttgcttcactaggggctggacagtgggctggtccatgctgtggggtagcatggggctggatatctgatggctctgctcaggagttgttccccttaaggtagggtacgaagctggtccatattctggaaaaacatgaaactggttgactggcagcttggattgagatctgctttcctgaaggcaaagttccaagctgatccatgcttaaaggaagtgcaaggatggctggcaagcagctcagctcagtcgctgctcccctgagggtggagtgatggggtcatggttgttccactggatatagatttcaagtaggttgggttggggtgctatagcccctgaagtaaggaaggtactgtacctcctaggcagctttttcctaggagtagaaagctgtaacagctcagctgggtaatgctgcgctattgtgtgcaagcatggcgtaatggaggtggagcctcaaagatggaaagatgcagtagctactggtccccggaaaggacatattttattactgactctggtttagggatggcatcttgcagtaggggtttgggtaatgtggggaaaagggcatgatgttagctccttttctggagcaatccagctgtgtgaactcctgaaagctcccaaaactggatggagagcctgagaaaactgcaagattctccagcagcaaaacctacaggtgtctacagcattgatgaggagtgctgagggccttctgtttactttctcccgacatgggaaagtccctcctggttctgagctgatcctaactggagaggtggcatggcaatgtcaagatgtctcactcctttctttatgtggcaatcttgagtgtctgtgttccacagaatttctgccagtctcctgctgtactttagcattctcattcaaatactcttgtcaaactatagttgtttatttgtcgtttttgtccttttgtgtggtgggtgacaagcaccaagcaccgagcacctctagtcagccatctttctgacatcgctctcttaatatctcttattgtctcatttgaaatctgttttaccaatacatttcccattacatgtcaccagtaattatactttgacagataccaatgctgattaaaggcaaagtaaaactgaagaaatatttcattacctgaatgaaaaaaaaatcacactcctctatgttatgtcacagttaactaaaactaaatactaatagtcctgagtactatagtaggtacatgagccacatattttactatttatactatggtttgtattaaatttaaatgttctttgagttcagtatttttaaaaagtagaaaggaattcaaagatctcaaaccagtggtacagcctcagctaaggcacacagaatgtttctccaggtaatatgtctctaagcatgagctatcaatagcttttctatttgtattccaattataaggagcttcttgaactggaattttcagagaagccatgaaaatgtactagtttagagactctatgaaaggaaataattctgatgtaatttttatataataatttctaatatgcattgtacattaggtacaacattttcttctctatttttctttatttgacaagaagaaaattaaaggtcagtatttttgatatttttcttttctctttttttatcattctacaaaagatgctaaagttagtctatcagtctgaagaccaattgtatttgaagctaacctatatagcaagattaattttttctgtcagtggttttctgtcactaagcaaatggtccaaaatgagccacttgactaactaacattaacatgtaattgtctagaaatctaaatagtatactactcgtattcaagaaaaaaatacatttggaggattcctgtcactttttttttttttttttgatgattcagggaaagtacccatgaaatttagatttggggaagggcataggggaacatagtataattgcagtctacttttactcaccagtacttcaagagtaacattctatcccatttttactaaaccattatatgttgaaataagattcatttcagatgtcattttgcaaaattcctgttaagatttaagcactggaaaaaaattttttaaactagtgcaattactttcttttcagctacagattttcttgacatgactagccacaactgtctaatattttttatattttaataaacactgtataagaggaaacacaaattttctccaatgaatgcctatcaacacacatataataactaattttcttgacaggcttaacaacggataatgtattactatttagcaaccaattctagtagacagatttgaaaaacaaataagctgttgtctagttctatttcaatatatatactcattgctaatttaaatgtagacaaaatcttactcagtcctctctataagtcaagctttatcttgcaggcaaatgtagtcagatatgtaatttgcttgtcagctattgccatgtgttcagaaatggagttatttttaacattttaaaacaaacttagattcttaacccaattaatattatgtctgaacctaaaattaccaaattatgttggcctccatacccattctgtgcacatacatacacaaacacactcatagatcatttatatctactaaagcatttgtttttcattttgctgtatatagataatttcacaaaaagtaaagcaaaatcttgagagttttaggaaaggcagagccatctactgccttcacctgccatacacaaatattaattcaactatggttttgagaatataaacactagaaaagctgatataatataaaaagtttacagcatgtcaaccactgtgaacaagacatttaggtcatttttaaacagttacttatccccccaatcatgtgaacaatacagcttctgaattaaccacctagcattttaggaaaaccagaaggagaacatcagccatctttttatctccctgtggtaggcaggaagaataaccctcccccttaaaaaaagtctatgcccaaatcaagaaaacctgtaaatatgttgtcttaattggcaaaaagaaactttgaagacataattaaagttaaggaatttgagatgggaagttattcttaattattcaaatgggcccaataaaatcacatgagttcttaatagtggaagaggagggtagaattgttgatgtgggtcggagagactgggtgatggaagaagaggtagaggtgatttgaaacgtgtggaagactccacttactgtttctgtctttgaagatgaagaaaggaggcagtcttagtctgttcaggctgctataacaaaataccataaactgaattattataaacaatagaaatttatcacagttgtggaggctaggaagtccaagatcaaagtcctagcaaattcagtgtctggactcactgtctggctcatagatggcactttgttgaagtgtcctcacatgtcagaaggggcaaggagcttctttggggctcttttataagggcactaatctcattcatgatgcctctgcccttgtgatctaatcagttacctcacaagggccctacctcctaacaccatcaccttgaaggttaggatttcaatatgtaaattttggggagacataaacattcagaccatggtatgggctatgtgccaaggaatgtggacagcctctagaagctaagaatgaccctcagctgaaaaccaccaagggaaaggagacctctcttctaaaactgcctggaactgaattctgccaacaacctgaatgaacaagaaaatagattctcccttagcgacaccaggaagaaatgcagccctgatgacacctagagtttagcatagtgcaaccaatgtcagactttcaacctacagagctgaaagatacatttgtgctgttttcagtctctaagtttgtggcagcaatagaaaatgaatacactcttcttacaaattttgtctgcatatttttattggagtgggtttattttaaaacaagataggacttgtgagtttaaactaaagattcttagaacattctggaatgatatttatttttatgaaataatttctagtttaaacacatgaaattgattttagcttgcattctaagtcatctgagatttgaaggatgttccatgtcttagtcttatttattggggcaactttgcaattccaaaaattatatacacaaaatgaactcctcttgtttctgtgtcactttaactagagggtctatgtgcaagacaaaataccaatccttcagatttatttatttatttttagacggagtcttgttacatcgccaggctggagtgcagtggcgtgatctcggctcgctgcaacctctgcctcccgggttcaagtgatcctcctgcctcagcttcccaagtagctgggattacaggcacgggccaccatgcccagctaatttttgtatttttagtagagacgggatttcaccatgttggccaggatggtctcgatctcctgacctcatgatctgcccgcctcggcctcccaaagtgctgggattacaggcatgagccaccgtgcccagtccatatttatttttatactcaagctttccctttacaaactttacccaaattacagtgataatgccagttactttttcataagaaacagggcatctgcaacattgattatcaagtggttctgaaattcccactgcccacactttgttctctcaagactttgagcatcataaactaactataatatacattcatcatgaagaaaagatttactttttacccttaaaaaatcacaacctaccagccgggcatagtggttcacgcctgtaatcctagcactttgggaggccaaggtgggcagatcacctgaggtcaggagttcaagaccagcctggccaacatggcgaaaccccgtctctactaaaaatacaaaaattagccgggcatagtgatgcatgcctgtaatcctagctacctgggaggctgaggcaggagaatcgctggaacccaggaggcagaggcagcagttagccgagatcgtgccactgcactccagcctgggtgacagagcaagactgtctcaaaaaaaaaaaaaaaaaaaaaaaacaagctaccattttctttgtctgtttctgccacaatgactcagtgtgcaaagtagtatgattcacgggaagtctaaacaatctatttctttgtagactacacacacacacacatatatatatatacacacacacacacatatttacatatatgcatatgtgtgtatatatatatacatatatatatacacatacatataaaggttgagctcaataaagaaaaaaaaaaatgccagttagccattgtgtgtgctttactcgattgagaactttttctaactgagaatgagctttttccaacttaaacctatttgtaggtttgtgccaagtgaaaacaaccagtatgagcataattttttatttgaattttcctgttaccttttaactcacttatactgtttatattatatgaattttgtatctgacctcctcattttgttggtagttgtattcatttgcctttctatctgtccccaaaatcaccgaactcattgaatgacaaagaaaatgttctcagtagaaatgcttgttgactccttgtgctcaaagagctggaatttaaggaaaatagaccttgagttaaaagacaacatttcacgatgattaaaaatgatagagacaggtgtcaaacaaacttaaaatacatatgcaattaatttgaggtacagttagtagggaacacttgttgagaaatctaaattggcaggccatcactctaagcaggagaaataacaaaagaggtcacttggggagattcaggagacaacccagccctttgttaagaactgtcagggaatacaattgagtatgtatggagggcaacaagatggaaagttattcacaagatatctgaaaaacaaaattggtgtttctgaacaggagaagaatgagagcaaagagaactaacatttattcagcaattactataagccaggcactgtggtatttgtgtatgttatctgtttaaatcctaccatcagtccagaaaataatattatctctatttttagaaaaacaaaccaagattcatagaaattgaagtcatatgagcagttgatagggtttaaacctagaactgcctgatctcagtgcatctgcacttgttctataatattgagagattaaattctccttcaacacttttgagctataattctgcagaatatcagtaaagatatttgaattgtccatatgaaatcattcaacactgaagttcttaattcctttttaacagtcctttttaaaatcaggtaacaaattcttaattgtttttcaacttcatgccatctctatatatgagtattattatttgactacttttaggtcacatggaatctacacatggaaggacataggcattgcatgcaggtatccggaatcattgatattggtcttaaaatttggaagtttccacttttgctaaggtatgttttccttaatggtggaggtttactaattgggtgtacctccagatctaattctttcatgtaatcctcatatgataggaagtaatgagatgaatatcattaggcattttcaaatttgaattgaaacatattacgatatgtttatattagagactggacaaaattatcattaagattctaaggttctacttatcattaccatgaatgggttttaaactgctaactagttaaagaactgtaaatgaaaaaagaaaaaacaactttgatcactcctagctatcaaattaccatatttaaaaatgtctaaaagtcattactgttgaaactatgattgtttagagtttagacagttgtatacactcaagcagggagtataaaaagggtcgctattctagaaatcgttagcctatactttaaaaaaattatagccattgatactgtgataaactttacctgaaatctgttcatttgtttaagtatagacaacttaatgtctatatgttaagtaatgtcagtgttaagtaatgtctatacttacagaaattaacagattttaggaaaaatttatcagttatattgattatagcttaacttgtattaattttttaagatacagacacagtggccaaaataaagaaaaggtcgatacattttatccacaaaatgggaataaaattactttttttttttgagatggagtctcgctctgtcacccaggctggagtgcagtggtgtgatctccactcactgcaacctccacctcctggcttcaggtgattcgcctgcctcagcctccagagtagctaagattacaggcgtgtaccaccacacccaacttaatttttgtaatttttagtagagatggggtttcaccatgttgcccaggctggtctctaactcctggcctcaagtgattcacccgacttggcttcccaaagtgctgggattaaaggcatgagccacagtgcctggccaataacattacatttaaatccaatttaaaatgtttctattctttagcatgattgcaatataatattagataaaatacataataaagttaataaaatctctaagagaaatgactgagaagaaattgttaaaagtattaacaataattaactgagaaatcatgggttatgagtgatttttaacttttgattataactttggatttctctatgataatcagatattgcttttaccaaagcaaaaagtttattaattgccaattgtagaagccaatttgcctgtatattttatagacaaagaggatttgtttgttttccttgttctacattacattaccatgagttctcttagaatttttaatttaccacttattattcccactgataaaataattcaagttgagtttgagtgtattcattcctttccaatcttggttttgaggtaatatgattttttatttacataccatttaatatcattattaccaatgtgtcatttacatgaactaatttacttaattttaagtgtaaatgtcaatgaattctgttagattgtatatcattttatttgtgcttgctattttaatgctccaagtttaaagttagagtgtgaataacatcctcccccaccttcacacttacaatactgaagcccattaaagcccaggttaggaggatttcctgcttcctcctctcttctactttccttctaactccatgaaatatttaagaatccccccctgaggatcctacaattgttaggaatgtagtcctttttgtttcctcagtcatccctggggctctaaattgagcaactcaatctttattttgaagccaaagactttcaattgccaccaaaatttgctttgaaagtaaccagtgttggataacaacctgaaaacttgggagcccagtgtgaagctaaggggcataggtagccagcaatattacttcagaggtggtatagctacattacatttaataaaaacagatcttcaacattcagttatttttagattctatgatgttagtttcccatttaaattgtatcctcataaccaaccaccaacctccaatcctcacaaaatctttcctgatggtcaatcatggagggggcggacataaaataaaaatataaataaacagggtcgggctggtaagagaaaccagaaactgagaagacaaagttagaaaccagtaatcaacatgaaaatgtaaggttccaggggattttaaaatctttgggagagttttgggttacacagactatggaatgaaaattgaagaaaatttatgcagttagcaaaagctaaggagatttgaaaaatgtgttctttagcacctcaacaatttctgaaaaggcctggagtgaaggtaatgtaagtattttgctgagactttcaaaaacaaaaccagggagatggaaagtataacataaaataatattgaggaaaaacaacaacaaattattagaaacttaaacaagaaatatagtttggatggcaaaatcttcaaaaggaactgtattcaacacagcagtacaaagtcacagggatcctgagtacataaggtcaatcaggaggaaaaagggggctgtgggttaaggccaataaaatagaattgtttttgaagtgaaagcctcaaagaaattttatttacaaagatttttattacagcaatatatttaatgtaatatcatcgagagtctcctaaactatgttttgagaccttaaacctctttgagcattgcattgtaatctatgctacttttcaagaatattaccactgtcaccagtgattgaatattaaacatttcctgtgtttttctctctgtatatttctccccactcttcctgctctttacttctgtactaacttcttaaaactatagttaagggcccacaaactcaaatgccgtcagggatgaagcaggcaaaggcaaaatgaatgtatcacaaaagtaggtgatggagactgtgaaaagacagtgtgtctggctttttttttctctctctgtcaaacacacacacacacacacacacacacacacacacacacacacacacttctatagtctgaatccatggagcactggtttgtaactccaggtgtaattatagtggcctctggagtaagacaaataggaaacccactttctacatttgtaagaaatgttgacttgggcaagttatctcacttctataagtctacatttcctcttttgtaaactgggaataataataataatacatatatataatatgtataacaacaacaatataatatatatatattttaaatattttaatctcatttttcaagatggggattactatagcactttttgttaaggaaatattgagaacacatttccatcttcagtcttactccactaataatctactaagttatttgaaccagattagttttataaatctattttaaacatttttaatatttaaatataatatttagttaattatatttgttcctaagaattccaaagtataaataatttgatattttaacacaatttattttcttctttcatttcatgttcctagtacgaactcttatgaaaggaagtgaccacttatgctattttgacttgattcatttagcaagggagaagttacaaatatgctgtccaaaagatgtttgtatggaaacagtttctcccacttcagtccccagattaacagggaggattagtgttattgacattaatatttataaataccatttagatgttcctccctctttttactcttctttcaattttacataggggatatgggctatgaagtgggcttgtcccatatctgaccctgaaggcttgagagagatagtatccattgaatgaagaaaatggcctgatgaaaatatgttgtacaaataagcacatttttaaaagtatttatttactctttatattgtattggtatatagtatgttttataccaacagttatctactgaaaatgaaaccctagaatgtaaacatgattttggcctgtgaaattcccagaaagaaaatttggaatagtatttcagaaaatcctcttatcaaatacttctgtagatgacaaaagtaacttggagggatcatcacactctagtaaattgttaaaagggttttttaaattaatgttagttgcttggtagtggcagtgaatcaggtgaacacgattacaattttccttatattttaaactgaaaatattaaatgggaaaaataaaaatatgagtcattgaggtaaatgcacaaaccagtgctcatgcatgtacacacgtacacacctaaatttttaaaggtcttttcacatcttaatatcaggaaacaagataaatatataaggggatatcaacaaattaataatatagaatcttaatataatgacatctatctaaaagttttcaagacaaaataatttctatttaaatagtgaacgtagtatttaccttttgtctttaaccagtcctttcgtgataataaatagaacaaatactgtgtcttcactgcatattcaaggtagtctaactgctataaaaaagaaagtcaataacttagcaaaataataattaattgttctttgaaacaacagcccaatgtgtttgtttatgatcaactggcccggttatccagtattgaaagtccatctgggagacacagaagggtgagagcagtgtaagggatgataaattatttaatgggggcaatgtatactatttcaatgatggttaaactaaatgcctagacttcaccactatacaatatatccacgtatcaaaacggcatttgtaaccccttaatttataattgaaaaaaaaaagtttatcttggggaatacacatagcttctcttaactgtcttggtctgggaatgacacatggcatttctttttttcttttttggtaatagttaaacccatgggcctacctagttgcaagaagctggtaattatagcttagctgtatgcccagggagaccaagaaaaccaggtactgattaacatttacagtctctgtcatacccataaagaaaataatgaagtgtttcagttcatttttttctggctttgccatttaatgctccttaaaggtgtcaatatgtttcatatgaaggtaaatgtaacaatgaaaacaaagcattaccaagaaaaataataattatcaaacataacaatatttctcctataattataatacttgtatttcaagatatgtagttcagcctttgaaattatgtaattctacttggatggtagtcatgagccttggcagattagacctgggcatttgggactgaactaaatagttggtctttacctcagttccaaaaagtcaaaacgacatatgaaacaatgtttgagaatgttgactctttattctaacagattcattactctaagcttgagctaacccccatgtattaggcagcacatagcatctatttatccagcttcattcagctcatattatttgacacaaagtatcacaagaatgtatttttcataattatataggactttcccactctcctgaaatacttttctcttcctttgtagcaacattattttccaaggaggcctcctgaacatgttcagtggctcaaaagatacagtttaagatcaggactgtatatgaatgaatgctatagtgttatcaaaccattaacctctgagctaatatgattatctgtacttgggttggacaggagacatctccaccccatcatttactttgtatcagagattgaataaacatctggaactctgcccaaatagcaatgcacatgatgatcaattagtagcaccatttttttttgttgcactgtatgcataaactacaaatgcctcacactgttcccattacatcttttcatctgcatattgaccaacataatcaataaaggtctattggagactttctgtttaggatccagctttgggagtacaattaataattcaagattttctaatgcatagaaaattgtcatttattacaatagtccctcagtttttcccacgaactgagaaaatacactgaatgttttctgccatcttggaccacattaatcacaatgtcttacccaatcctgaaaatccagttttaatgcctggtcctcagaaccatgatgtaaatgttttaggttataagaaaatgaaaaatttgtctagcccattcaataagtacagtagtacctagtgcagcattatcttgattcacactaaagtctagtagactcaaaatggttaactcaatattgacagaagtgctgaatgtttctattaagaaggtcttctctgactccttccgactactgtgggtttatcattgagctctcttatattttttctccagataaagtagaatctgattcatagcaatattgcatggtattgatgtgatctattaacagttaaaactggaaacagttcgccttgacaatgtcctttgaactattcagtggcactccgctttaacacacaaacttcagtttgcaaataaactacaatatctctctttcggacatactttctgtgcaaaattccataatcttttcacataaatcctcatggtaaagagcagcccgacatcctcaaggatctcatcaatatacaggaaaaaagaatagatagtagcatcaagtccacaaacactctcaaacacagcctttgcttcaaggattccaaaaagtattaaagaaaatggttgcctctatttcccttaattttgagttcattttagatcttactaccaggctgactaagctcagatcatagaggttggcaaggtagaagttatgtttgacaaaaatgttttaatgtctactgaagcagacaaattaaataaacaagtaattgtatatgctagtaagtgaaaagaaggaagtacaccttatgctttaatggagagtacatttatgtgcagagaaatttaaagaaggtggtcaggatagacttagctgaagaggtcgttgtgatctgatattttaagaagaatatgagcaatctacgcgcagtgtaggcaaatagtaattcaagcagagggaatagtaagtataaaaagctggaaatggaaatgggcttgccgtgttgaaagaataaacttgagtgatgtacttcaagcctactgagccataggagaatagtggaagatgtgtttggagatggaggctgaaccagcgaatacagataaattatgaaatatattgtatttccttttgaattaaatgagaaactaccaaatgttttattaaaagaatgtcataacagatatttgtttcaagacattactgtgtttgctccgtgaagaattaatcagataagagcaagtgtagaaccttggatgtcattttaatactctgttagataatggtttccagaacatgtaagtttgcagtggagatggagaaaagtgaatggattttaaatatattttggagttaaaactcatgggacttgctgaggaattgaatatgagatgtaaagagtaagggaagaggatgaatgaagactaatacctagtgtttttgttttgtttcatgcgttgggttatattttggtaaagttgattatgcttgtggaaaataagaaaaaattggggggagagtgtgtgttgaaagctctgcttttgatattctttgagatgtatagtaagcttccacactgaaacattcagtaggccatttgatgtataagtctgaaactcaagagtgtggtatataggggatacaaaaaattctcaagtcataagaatgtagatggtatttgaaacatggatattaagtgtgatcacctaggctgagagagaacataaagaggagggatgagagaatacctgtggaactattttaatacttagtgtttggatagaagaagccaaaaatacatagaacatcatgaccagtgatttacaagtaaatgtggtggcaaaaatgccaaaaaagattattcaaaaaatagagggtgaattttggcaaaggtagctgagcagtggaatatcgtaaaaacagagaaaaatccattagattttggcaacaaggaggatgttgatgactttgtacagaacagcttatgtagaatggtgatatgtgttatgctagagtgaattgactgaaggatggcttgaatataaaaaaaatccaattggattaatggcttgtctaaaatcaaaggaaaatgcacaattaaatcattattaactatagacaccctgttgtgtaaccacccaacaggttctcctagtccactactcagaaatgatttatcaagacaggagaactgcaacagagaaagagtttaattcatgcagagccggctgaatgggagaatggagttttattgttacatcagtctccctgataattcagagactgtttttgtttgtttgtttgtggtgtgtgtgtgtgtgtgtgtgtgtgtgtgtgtgtgtgtgtgtgtgtgtgtgtgtttaggataatttggtgggtaggggattagggagtggggagtgttgattggctgggtgagagataaaatcatgggaagtcgaagctgtcctcttgtgctgagtcagttcctgggtgggggccacaagaccagatgagagtggcacctcctgattcatcgaatgcagaatctgtaaaatatctcatgcaccaattttaggttttacaacagtgatgtcttccctgggagcaactggggtggtttcaaatcctgtggcctctagctgcatgactcctaaaccataatttctaatctggtggctaatttgttagctctacaaagggagtctggtccgcaggcaagaaagtggtttgttttggaaacagctgttaccgtctttgttttaaagttaaactataaactatgttccttccaaagttagttcagcccacacccaggaatgaacaaggacagtttcgaggttaaaagcaagatggattcagttaggtcagacctctttcactgtcataattttctcagttatgatttttgcaaatctagtttcagttgtgctatcaaatgctaagtcttattcattctttctatttttttgtacccattaaccatccccacctcccctccacacccacccactatccttcctagcctctggtaaccatccttctgctctgtctccatgagttcagttgcttgaacaaatggatatcagaggatgtaggaaatgacattgatctattaataaaaacaataaaagacttgaaaataacacaaaaagataggcatgtgttcttttaataacatactgaagcatcatctaaaaggacaccccaggtattatttaattctctaaggtatgtacctttattaacatactattgtttgtgcatacacctatgaagttaaatgttaatttgtattttttatctgataaagatgcaaatgatttctgtctggtagaacaaagcaatacgattttattgtcctatagggcattaactagttctgaatctaatatagcaatttcattccaaaagtctttcttcagttttaataaatactcctcagctcttcaaatgttctttgaatcaggcttattattctgccgattaactctaagttcaataaatttgacatatatttatttattctatatttttatcatatgttagtttgttagggctgctataacaaaatagcacaggctgggggtctcaaacaacagaaatttactttctcatgattctggagggtagaaggccaagatcaaggtatctgtaagtttgatttctcctgggaactctctccttgactggttgccctgtcactgtgttctcatatggtcttttctgtgtgtatgcacattcctggtctctctgtgtgtatctgaatttcctcttctgataaaaacatcagattggtttaaggccctcactaatagccgtattttaacttaatcatctctttaaggctctattgtcaaatgcaatcatattctgagttaccaggggggttagggcttcaaaatgtaaattttgggggaacacaatttagttcataacatgtgaaaatcatgtttgttacttttttttttcaaattatgccttggtagttttagaggttacacaaataaatatttggcctataaggctgtattgtcaaatgcaatcatattctgagttactggggtgttagggcttcaaaatgtgaattatgagggaacacaatttagttcataacatgagaatcatgttttttagctttttttttccaaatttatgccttggtagttttagaggttacacaaataaatatttggcatgttgattccccattctctattttaaaaaatacttaggacgggcgtggaggctcacacctgtaatcccagaactttgggaggccgaggtgggcagatcacttgaggtcaggagttagagaccatcctggccaacacggtgaaaccccatctctcctaaaaatacaaaaattagctggacatggtggcgggtgcctgtagttccagctactcaggaggctgaggcaagagaatcgtttgaacccgggaggcagaggttgcagtgagccgagatcgtcccactgcaccacagcctggtgacagagcaagactccaactccaaaaaaaaaaaaaatacttagaccaactctttcaaacttcatattgcccatatctctcagatacttgcaaaatgaaacttgatgtttgatagaggttgagttttctgggaagtaaatgatgagctggaattatgagggaaaatgtttattgtagaataacaacagatggggaaagaaaagggagataaggcagatttagacatgcggagttgttaggacatgatttgtacttgacaaaacttctgaacatcaactgagaactctggaataaagattactcaataaaaatatctttccttggaagttgcctatgcccttgtaccaccaccatgctcagtcattggctgattgcttcaggagagcatgactttggctcagaagttgatagggattctgttaaagctaacggttggaggctgtcaactaaccacagccttcagaattggacagcaagttctttcttgaagaggtctatgagtgatgtatccgtaggtctgtcacaaagtttaaatcacaagaaaaaaaaagatatatgaaaagggaaagaaatacaaaaccattcaaaatattttagtaatggtaataatttataacatatttagttaatatgtgccacagactatttaacagttcataatattatcctctttttcccccattttcctcaatccaaagaggagaaaattataaataaacgaactgaatctttttactgtcaatgattttaattgtcatatttgagcactaagaaatgttaacaacaaaaatacattgtttagaaaggaatatcgcatttttagtagcatattctgatttgaaatcatttaacttcgagggtaatttatttagaattatattctagcataaaaatagcacaaaattttaaatagaaattaatacatgtcatttaataatccctccaaacaaaatttattgagggatgtgcatgcttacaggcatgtataattctaagtattgagctacaaacatttatgtatatctattaatcattaggcttttacagattttcaaataaactaaaaacagtattttaaagttttaaagagagtgaaacatgtaacacttcaaagcctgaattttcatttttgacttttttatttttaattgaaattattttattacttaaatatgcaagaaataaatagggcagtttgttgaaaacatgtattcatgggttaagtaattagatccatgttcatgaaactgagaactatctgataaaactgcttgaattaagagtccaaaaactatacactgaactggatatcatctataaaactgatcattaccttaagcagttaaattttaaaactctgtaaatctgcttggtgtggtatatgtcttggctctgtgtccccacccaaatctcatcttatattgtaatccccatgtgtcagagaaggggcctggagggagatcactggatcatggggtggatttctctcttgctgttcttgtgatagtgagttctcatgagagctgatgattgaaagtgtggcacttcccctgtgctcgctctcttctctcttgctctctctctctctctttcgcctccacataagacatgcctttcttcccctttgccttctgccattattgtaagattcctgcggcctcctcagccatgcagaatggtgagtccattaaacctcttttcgttataaatgacccagtctcaggtagttctttatagctgtgtaaaaatgaattaatacagtgtgcctaaaaatacctcaaaattagatgatttatgtctagattccacctcaataaacaataatggtaaaatttggaagtatgattaggtaataaaaatggaaaaagtaacagatatttctataaatatgtaaatttgcaaataaaacagtgtttgatagatcaacagaatgactatagttaacaataatgtattgtacatttgaaaatagctagaagataataattcaaatgtttttagtgtaaagaaaagataaatacttaaggtatagatatcccaattgctctgaattgttcttttcacattatatcaattaaaatatcacatataccctaaaaatatacacatctattatatatttttatttaaagttacactcttcattgattaatatttcccaaatggctttaccttgttttaaaaacttaactcttccttgtgtcaagtaattaccttggataatttcttttaaaagaattaataattgttaaaggaaattatctttaaaaaaactaactttatgtggtacagaatctcccttttatttccctctctctctaaattgtagctgtggtaaggcttgtaaattaagaagtgttacactctggtaacatcttcaggatatctttttaattagtctctagagtgaaaatttccagaatattcaaatgcatccccaaataacacattttcagcgaaactttgatccaggacttttttagcacatttattcatttatacaattttctcaaacacaaattaagtatattttgcagcccctatgattgaaaacaatattctctcttaactccgccagatccctaagcacctttaaacaagaaatattaaggcctccttatctaacatctattaataaatgtatctcaaattaaaatttttcaagtattgggtttttctatttgcccaaaagtcccctccccaatacatatagttaattgttgcaatgatccctagtaacttactagtaaaatggttattttcctcagcacaacacacatgggctccaagtccttgtccctgcctttctgtccaggcttatctggcaacactctgtcttataatttaagtgttagcaaaagcaatggtaactcctctcttccagatagccatttcaacacactctttttcactcttttctaaaagtgtactgcagaaaaaaaatttgatacaattgaacacctcttcatgataaaaacacaacaaactaggccttgaagtaacatatctaaaaatagtaaaggtcatatatgacaaacccacagctaacatcataacatcataccgaacagggaaaaattgaaagtctttcctctaagaactggaacaagacaacaatgcccacgctcaccaatcctattgaacacagtagaggaaatcctagccgcagcaatcaagcaagagagaagagtaaaactggaacataggaagtcacattttccctctttgctgatgatatgatcttatattataaaaccctaaagccttcaccaaaaatctcttagatctaataaataagtaaatttggaggatagaaagtaaacatacaaaaataagtagcatttctatataccaataatgaactacctgagaaagaaatcaggaaagcaatcccatttacaatagctacaaatggataaagaaaatgtggtatagaatactattcagccataaaaatattatgtcatttgtaactattgatgaaactagaggtcattattttaagtgaaataagtctgacatggaaagacacaaacatcacacgttcccactcatgtgggaactaagaaaatagatctcatggaggtggagaatagaatgatagatactagaggctgggaagagtatatggatggggagcagataaagagtgattggttagtggttacaagtatgttagatgaaaggtgtaagttctaatgtttgatagcagagtaaaatgactgtagtcaataacaatgtattgtacatttcaaaatggctagaagagaaaacttgaaatgtttctaacacagagaagtgataaatgataaatgctcaaggtggtgaacacctcaaataccctgacttgaagagttattacaccacctatgtatgtaacaaaataaattttcttaaaaagaagaaaaaaagacaagtgttccacttttctccctgtagcattctatgcatgtctttatcatttttttcttctcattttattgtgattatcaatacttgtacaatagtttacttcaatgaggcgtatgttgtagacatctttgcatcacatgtttcaagctctggcaatgtgatatttttcttctaaattcacaataatattttcaagagttcatggatgttttttcacatatagatagccatagcctaatgtactgatattgagtgttcagaatgtacaaagagtaaaatcatagtgaatatatcaagctgagtcactttttctcttttattttttgtatatgacaactttctcctaatactaagagagagagagagaggggactgacttgagtaaaaataaaaataaaaatttagtaccttttcccctcattaacctcctgctggtgggttggcattgtgtgtgcaatatattgactccctgtatttttctatttcttttttttctttcttttttttttttttttgagacagggtctcacactgtcgcccaggctggagtgcagtggagggttctcggctcactgcaacctccgcctcccaggttcaagcgattctcctgcctcagcctcctgagtagctgggactacaatttttagtagagacagggtttcacaatgttggccagcatggtcttgatctcttgacctcgtgatcctcctgcctcggcctcccaaagggctgggattacaggcgtgagccactggcacccggccgactgcctctatttttctaatgctgtgctttttctatcagagctttttagaattcctattaaatggcaattctgtttacttcctgtattagcaaactgatatatattgtcaggtgctgagcatgggataggttgtatttctaaacacattactattgatttctggctcctttgaaattttcctccattgttctaaatctgccctgttagattggtcatgtattttcactgagacctttgtgttataactgaatccccatttagcttccctctattaggcttatttttctgtgttaaagttcctgttgattttggtaacttagagaaaataccatgaatctagaatcatttgtatttacaaagtcattccatctgcatcagaactgtttgattctattatttttgactgatagagattagtgagaaacatggaattagatagttttgctatatgaacaaccaacccaatctcaatggcttaaaatagtcattattagagtttcctagaggtcacctggtttaggttagactcaactgagggtcttgggtttaactcctttatgtatctgtaggttgaatggcaggctctaggctgggagccaagaagcttagctgcaaagctctgttccatgtgccttgaatccatgaattttgagccatcctagatagttctacctcaacagatataatggaagactgtcagtttgggtcccctgagagacaaatgataagatagtattggatatgtgcaagacttattgagagaaatgcccttgaaggataaaggggattgggaatcagattaatgtggacacactttagactccagtgcagatcttacacttgtgaaaggggagaaaagagagtaagaaggatcagcagaaggagccttagagtgcaatgcagtttgagaaagtcttggccagtttaaaggtgagtctcagaacatagatgcccattagatgagccccaggagtcccacgttgacatgggactggcttttgtataccaactgtattcagtcactagctaagaccaacctgagaagagcatggcttttgcatgaatgcggaggcaaatccaatgtgtgtgtcagctggaggctctcagataattactcttctccaagttctcttttgaaaagaaatttgagtggcaaacataatgattgctcctaagattctttccagaaaatgaagatcaagatttcttttaatcaactaaatataggctcttggatttattctgcattaactagcatgtaaggtttcacttcttgattaatataatcataagagaaagagaatagaaaaacttttatttggaaagtcactcaatgaattagtttccttgctgtatgctctcttggctgtaagctaaaaacaaacaatccacaataaccaacacaatactgaagcagaagatcaaagttggagaactgatactacttgatttaaagtcttgtattttagaagttttgtagtttcacataatacattgaggtctgtgatccgttttgagttaattcttgtgaaaggtgtaaggtttgtgtctagatttaattttttgcatgttgatatccatttgttccagtataatttttgaaaatactatcctttctccattgaatggcttttgcttctttgtcaaagatcagttgactatatttatatgggtctatttcagggatttctattctgtttcactgatatatttgtgtattcttttaccaatatcatactcttgattactgcaaaattgtcatatatatgatttgcaaatttttttattccatcggttatcttttcattttgctgattgtttccttttctgtgcagaagcttttaagtttgatgtagtgtcacatgttcatttttgcttttggtgttgtgtccaaaaacaattattgccaagactgatgtcaaggagcttttctcctaagttttcttctaggaattttatggttttagctcttacatttaaacctttaatctatttcgagtttttttgtgtgtgtgtatgttgtaggttaaaggtccaatttcattattgtgcatatggatatccaccttttccagcaaaaatttttaaagagactgtctttagttagaacaccagaagcatgacgcatggaagaaaaaacatgtataatttgaacatttttgaaattaacgtgttttgttctgtgaatgttaagggaatgaaaagactagctattgacttggagaaaatcttttcaaaagacttatctgattaaggacttgtagccagaatatgcaaagaaatcttaaaatccagctgtaagaaaacaaatgttgtagtttattcaggctgctaaacaaaatatttagactgagtaatttgtaagcaaaataaatttatttcctatagttctagaggctgggaagttcaaggtcaagccaccaggagattctctgtctggtgaggcgcctcttcctcatagatgataccttcttactacaccctcacataatagaagcaacagacaagcttcctcaggcatcttttataaggacactaatcccattcatgaatgctgcgtcctcatgacctaatcacctcttaatggccacaccccttaatagtattgtattgggaattaggtttcagcatatgcattttggggcaacacaaacattcagattatagaaacaaacaaactacaaatcacaaaagatcagaatagacacctcaccaaagatgttaaacagattgcaaatgtgcacatgaaaatctgctcatcatcatatgttattagggaaatgcaacttacaacaatgagatgacactacatatctattagaatggccaaccttttttttttttttttttttttttaatgataataccaaacaagtagtggtgaggatatggagcagaaacactcattcattgctggtgggaatgcaacgtggtatagctatgatggaggacagtttggcagtttctttcaaagctaaacatagtcttactatacaatccagcaattacgtttcttaatatttaccaatgagttgaaaccttatgtcacatgaaaatctccacatgaatgtttactgcagctttagaaatttataatttctaaaacttgaaagcaaccagatatcccttaatagattaatggataaacaaattgtgatatatccatacaatggaatattatccaatgataaaaagaagtgagctatcaagttataaaaatacatgaggggactttaaaggctattgctacattaaagatgcctatcttaaaaggctatacatggtatgaattcaaatatatgatattctgtaaaaggtaatactatggcaagagtgtattagtccgttttcatgctgctgataaagacatacccaagactgggcaatttgcaaaagaaagaggtttaatggacttataattccaagtggctggggaggcctcacaatcatggtggaaggcaaagaggagcaagtcacttcttacatcaatggcagcaggcaaagagaagtcttgcgcaggaaaactcccccttataaaaccaccagatctcatgcgacttattcactatcatgagaacagcacaggaaagaactgcacccatgattcaattacctctcactgggtccctcccacaacacctgggaattcaagatgagaattgggtggggacatagacaaattatataatttcaccccagccactcctaaatctcatgtcttcacatttcaaaaccaatcatgccttcccaacagtgccccaaagtcttaactaatttcagcattaactcagatgtccacggcccaatgtctcatctgagacaaggcaagtcccttccacctatgagcctgtaaaatcaaaagaaagttagttacttcctagatacaatggagttatagtcactgggtaaatacagccataacaattgtgagaaattggccaaaacaaaggggctacaggccccatgcaggtctgaaatccagcaaggcagtcaaatcttaatgttccaaaatgatcttcttttactccatgtctcacatccaggtcaccttgatgcaagaggtgggttctcatggtcttgagcagctctgtccctgtggtttttcagggtacagccttcctccaagctgctttcacaggttggtgttgagtgtctgtggcttttccaggtacatagtgctagctgtcagtggatctactattctggggtctggaggatggtggccctcttctcacagctccactaggcagtgccccagtagggactctgggtgggggctctgactccacatttcccttgtgcactgcgctagcagagcttctccatgagggccccacccctgcagcaaacttctgcctgagcatccaggcatttcctacattctctgaaatctaggcagaggttcccaaacactgattcttgacttctgtttactcgcagcctcaacaccacgtggaagctgccaaggcttggggcttgcacctctgaagtcatggcatgagctctactttggcccctttcagccatggctggagcggctgtgatgcagggcaccaagtcactaggctgcacacagcagggggaccctgggtctggcccatgaaaccgtttttttctcctaggcctctgagcctgtgatgggaggggctgccgtgaagacctctgacatgtcttagagacatttttcccattgtctttggcaataacatttggatccttattgcttatataaatttccacagccagcttgaatttctcctcagaaaatgggattttcttttctatgacattgtcaggctgcacattttccaaactttcatgctctgcttcccttgtaaaactgaatgcctttaatagcaccaaagtcacctcttgaatgctttgctgcttagaaatttattctgccagataccctaaatcatctctctcaagtccaaagtttcacaaatctctaaggcaggggcaaaatgccaccagtctcttggttgaaacataacatgagttacttttactccagttcccaacaagttcctcgttcccatctgagaccacctcagcctggactttgttgtctgtatagctataagcattttaggcaaagctcttcaacaagtctctacaaagttccaaactttcccacattttcctgtcttcttctgagccctccaaactgttccagcctctgcttgttacccagtaccaacatcgctttcacattttcagatatcgtttcaacagcaccccactgctggtaccaatatactgtattagtccattttcacactgctgataaagacatatgtgagactggacaatttacaaaagaaagagatttaacggacctacagttccacatggctggggaagcaccacaatcatggcagaaggtaaaaggcacatctcacatggcggcagacaggagaagagagcttgtgcaggaaaactgtcccttatgaaactatcagatctcacaagacttattcactatcatgagaacagcacggaaagacctgcctccatgattcagttacctcccactgggtccctcccacaaaacatgggaattcaagatgagatttgggtggggacatagccaaaccttatcagagagtaaaataagtggctttcaagtgttcagggggacaaagggagggaggaataggtgaagcaatgagatttttacagtggccaaactattctgtgtagtactgtaattgtaggtacaaaacattatgcatgtgtcaaaacccatagaactttacaatactaacggtgaacccttagataacctatgaattttaattaataacaatgtatcaatatgggtttaccagttttaacaaatgcatcacactattcaagatgttaataatagtggaaaattttggtggggaggagttttgggaattttcttgtacaatctgctcattttttgtgtgaacctaaaactgctataagaaaatgaagttggttgttaatctaagaaaatcaaacaataatgccagtactcattgactcatgttttagtgatctttgtctttcctttgacaggttttagaaagatataaattgccctcctaattctgccttttgccagttatatgatcttggtccattttctgaacctcagtgttcccattggtgaaatatggttaacaatacgcaacagataacatgttgaggatacctgcaggaggaagagttgcatgagatcttcaatacatgtcccttcctttcaccttttttaaatattctctcctagcaataaataaataaataaataaataaataaataaatgtggggcttccccagccatgtggaactgtaggtccattaaatctttcttttgtaaattgcccagtcttgggtacctgcaggaggaacagttgcatgagatcttcaatacatgtcccttactttcccctttttcaaatattctctcctagtaataaatgggaacaatttgagacaaacatcccttgcatattttcttattgaaccatgtttatttcaatacccactctcctttcctcaatatcactcaaatttttgtattttgttcttcctttttttatattttcagatctcagaacacaacttagaaagtacctagagtatttacaatagggtagaaataagttgttcagcattctattaaggaattatttttggtgaattgttgaggcaaattgtttggtgaattgactgtactctagccatagcaccatgagagattgaaaaaataatcatgaataaaacataagtcctgcttttaagtaattcacagtcagagaagatgcatgagaagaaaccatactgatatagtcatcaacacctcagtgtgaattcattttagatagttttctcagacatattgatgcatgagatgtggcctcagcataagaatgctgtgaatcccagtgggagaaggtatcccttaaaggaaggtggggaattagagaaattgaagtttactagcactaaataatactctacttactttgaaattatattcattaagagcaaatactctccccttaaaatcctatgctttgaagtgaaaaattcagtatgaaagatttgtatcggtggaaacaaaaaaaaagaattatttatgtacattaagctttaaagagattttggatttttaatccttttatattgtttctaagaaactcattttggtctttttgcactacaaaattaatgttcctacagtgtttgaactttttgtttctcctgcatgtataaactttgaatataggtttcaaagaaaatttaataatcttgttttgttttacatttccttaattaaggtgttaattatgatcaaactgcatgacatcacaatttgtgagggtaaaattcactttaccctcactctaatttttactaattttattaataaatgatgtgttttcagcaatgttttaattctttttattcatgaatattatttcctagattaatgatatctgtagaacctgaaattaaaaagctattctggagcaattaatttatttacctgaattttcaatattaacagtgttattttcataatatttatattcattcatttcataatttaagtttttcatgaaacagtgtatatatttttaggtaatacccacaattctaagtatgtatgtcccaaatttcctgaagctctcttcagaaaagttacagagaatattaattagatatgtatattagctctttatctagataataggatataaaatagatcattcaaatataatagtatgtttgccttccaactcatccctactttcctttttaaatatagcatacttttaaaatattattttgtattatttcaaagttaaagagaccaaaaaaaaagccctaccatttccatgaaattaaatctcccttctagaaaagatgtattcagcatctacttgggattctttgctttaaaacttctgaaagatttcacaaaattaaccatgaaaacatgaccagcagcatatattttccaatacagtatctttcatcacctttatgtctgttggatttttatttctcactatgtctcaaacccttagtgttttacatagtagttctgtcttaagatataatgaaacttattttagtacagagacttttattaagaataatacagtgaattttattatggtgtattagaccagaatctagacaaatattcttacagtggatgtggatgttcttatgaatctattacactctagagattaaaatttctacaataacatcaaatacttcctagtggacacaaacagatatgatatactatgaagaataaaacttacaatttaaccgtagaatttagatttccagcagtgaatatataagcaataaattatacaagtgactttaccagcagtagtagcaaattttgaatagagaataaagcaactgtgttccaaacgtgtcaggagaacattagtagtatcattataaatgccagatacccactcctgcatcaattccacatatttgaaattcactagcttgtgtgacctcgaagtttccaaatattgaagttgtatctggcaaagtgaataccataacactagttaccttggccctagaaatagtccctgttttagggttaaagcataattactttattactaatgataattggtgaaaatgtgaataaccggtaggggaaatgatattggcttgaatgattctgaagatcagcaactgagcttgctatgtgatatatttttttaaaatgtttgagccagctggtaagaccttgtgtcagagggtaacaaaactccagttggtgggctgacatttaggattaccaatatatatagtccatctgacctttttttacacttccttttggtgagactgataactgatattcaatacaaagtatttaaatataaacaggtcatatttgtagctgccatgctcagaatagtgatgctgtaagagtattctagcaggtctattctgattctctcactgttgcaaaaccagaaaatctgagacaggtcttagttaatttagacagtttattttgccaaggttgaggacacacccataacacagcctcaggaagtcctgacgacatgtgcccaaggtggtcagggcacagcttggttttatacattttcaggagacatgagacatctatcaatatgtaagaagtaaattagttccatccagaaagacacagacagctcaaagcaagccctaccccaccccactgagggcttccaggtcacaggtaggtgagagacagatggttgcattcttttgagtttctgataagtctttccaaaggaggcaatcagaatatgcatctatctctgtgagcaaagggatgacttgaatagaataggaagcagatttgccctgagcagttcccagcttgaagggtcccaaaggtatttttcttacatactctgttttctgctctttatctctacgttctcattattgattgctatttcaaggttctgtcatttcttctttcattgttctcaagatcactctcacttattttcaaatattctttctgttgttaaaacctattatatttatagcaactaactgaaaataaataagaaattagaatacaaacaaataaacaacacttcaacaaataaatcttgggctgggcaggtaccacttcagagtaccatctatgcttttcccattgaagagaaactggccatcccagaggtgtttcaggctggctatttacttggccacactttgtactgtcttccccttaaccacccaaggacagctattccataaaggctaagcaatgcttcataagaaatattttcctctgttagcattttgaatgtgtaattttaatagaatgtgacagttaatagtaggagctgaagaacaagaggtatgtgatgtagaataaaagacagaaacaactataatgtgctatgaccaaaatgtacatggaagcagactaagtaaggtttcaaaagagcatagaaaaacactcactaagaaccatcacgtatcctgatgaaacttcagcccagttccagttttattgcgtagatgtctccacaataatttttttttctgagttaaacggaatgagttcttgttgtttatatcaaacagggatatcattaattctgacatggtctcagagcatctaaatgaccactgtgatccaagaaccatcatttctctggataataatgtagcctctttattgctctgcttcggtctttgctccagaatctactctccaacagcagtcagagaggtcattataaatgcatgatagataatatcataacttgtgcaataacctacaatgatttcacatcccagagtaaaaataaaaagtgcttgccatggcttaaagaggcctccatggctattcctctatacttgtccagctccaattaggggcactggcctcttgactcttctggaaatactcagcaaactttttttttttccttcagtcatttgcacctgtttcctctgccagaagtgaagcctcttccctagacatcaacttggctccccctgtcacttcccatcactttgagaagcttcaccctagcccttcaccagcactctatgttccgtttatagtgtcattattttactaaattgttacaacctgatggagcatatattaatttattatgtttgtggtcattcatcccctgctagaatagaagctctacaatggacagtggttgttttagtatatgggatcactagcccctgaaatactaccaagtactcataaagcactcaatagatattttttgaattaattagttaatatacaaaacttatgtatcataacctcatgattagaatcatctaatttcacactgaaggaatatatgatagttagaaggggataaggaaagagaggagaatatgaataaaaaggtggagtaactaaattaaaatacaatgtgcatttatatcttcacaatacaactaaacttcatcatcatttgtctagagatctgagacaaaaatcagaaatagagaacaaggaatgtgagaattaaaaggaaattacatttaataatgatgtttatgtaaaatgtgataggctaatttaatataaatccaagaaagaagcataaaatggaggatatatggtaaatatgtgacacataaaatttttattaaagcaaattagtttaacatcattttatcatcaattacttccttattcacaattcagtttcacctcctttgtatatattttaagctgtaactttgacacaatttatgacaaaggaaatatatacttcaatattatcacactgttagccgaaaatatttgaacaaaaataagtattgctttccaaataattttcttaaaggaagtacagtcttaccactgaaaattaaaacaacaatctaggtgaattgttatattgttccaaatatgatttataagattctaatgtttttatgacttacaggtcttttaaaaaactatttgagagacaggaatgtatattagattattttatctggtttaggtagaataaatgtaagcaatgacaagcgatatatacctcatcatgcttatattttcttttcttttttttttttttgagacagtgtctcgctctgtcgcccaggttggagtgcagtggcgcaatctaggctcactacaagctcctcctccctggttcacaccattctcctgcctcagcctcccgagtagctgggactacaggcgcctgccaccatgcccggctaattttttgtatttttagtagagatgaggtttcaccatgttagccaggatggtcttgatctcctgacctcgtgatccacccacctcggcctcccaaagtgctgggattacaggcatgagccaccgcgcccggcctcatcatgcttatattttctaaatattgaaaagacttaatagcaatcaattattccctccttttctccctcctttatcctttcctttctttcatcatatacataatatatataaatattagatatataaagtgcttataatgtatcaacgtacaacatcagtcaaaatccctacccttaaaacagactagtcagtcttcttttcttcattacattttcatttctttctgccttcctttctttcaattataagatgtaattcaggaatatatcattcctccctttttttttcttctcctcctttcctttctcccttccttccttttttattttcttcctcccttccttccacaggtattccacgaataagtacatgtaaaagatccaaatgatacggaagtataaagagtaaaatacaaatgcctacaactgcccttcttgtattctactgctcagagagcaaatgtgggtcatgagaatactccaaacaaatattctgcttcaggagaagaatgacagattttgtatggaggtttagcaacagagtcagttgtagatcagttggtttggggaataattactccaaactggttcttaaaagagggaggaatttatgttgtgaattagctgtcaaaggctgggcaatttgtgttttcaagaatggtgaggtggaacagttagggcctaaaaatatgtcggtgccagagtgggaaatattaagtcctttgtggtctcttacctatatttcataattatctctcattgtcaagtaatgagatgctccccctgagttcattttctacacatttaaaacttacccctgtgaacaggcacatattttttttttttttgaaatggagttttgctcttgttccccaggctggagtgcaatggcgcgatctcagttgaccacaacctctgtctcccgggttcaagtgattctcctgcctcagcctcccgagtagatgggattacaggcgtgcaccacaacccccagctaattttgtatttttagtagagatggggtttctccatgttggtcaggctggtcttgaactcctgacctcagttgatctgcctacctcagcctcccaaagtgctgggattataggtgtgagccaccatgcccagccaacagccaaacattttataattattttaatatttgtgacagaatgcttcctaaatggtaacaacagattgctataaggattattcccaaaagaaaaaaatcaaaattttttattgaatttcaataatgacctacaactttactaccttctatggctatgggttatttatctacaggttaaaacaataaaaatagctgtgtttcaggattttgtatgatgttgactttcattttcaaaattaatttcatattttcactcatattacctgcttattatcacctgtttttttttccttatttttccacccccactttctgataattattatgcatattaaaacaaacatatatactatcaaactgggaaggcataaattattgctgagtaaaatccccataccactttcccccagtcccaccttttgaaggtaactatttctaggagtttgctgcacagtcgtcttactatattttatgagtattccagtatacatatgttaaagcaaaggcaaacatttcatctatatatatacatatgtgtgtgtgagagtgtgcgtataggcatataatgtcttttaaatacaaatttaattctacagttcatataattttgcatttaaaaatagaacaaaatcatcatggatatttttttggatcagtacatagagatttattatattctttaacttctttgtattataggcagacttgtaactaacagctcctttccactttctaatttaatctgattttgtaaatcaaagattgcaccacttagaattgcactgtatttacttactggatgagagtgattgtctaaaacattctcctatgaatcaagtagctaagtcttcacaatttatttcaaacgtcacattctcacagcagccatcaccgaccactgtctataaagttgcacctcccaacatacacccaccccatcacactgtatctttcctttacagtgctaagcacgatatgaaattatcttttttttgcttcttcactgggactaaatcttcattaatcaaaatccttgtttggcctcttctttgatctatttccccgtatctagatacctccctgacacatagtacatattcaatatacattgataaaatgattgaatagatgaatgcatgggtgtgtccttattgcatcaactttacttacacatttacctgtcccttatttacctgtccttttacactgtagaatgttgagaatgccaggttagtgaactgtaagaaaatgatcaagaatgcatacaaactggaagacctagactcctaggagtaatttcacaaaacgcagatctgaagcttgaaaaactaaagttaagaataacttgcagggtttttagaatcattttcagagcatgactcacaacagcaaaaagatcacagtctaatttattgagagtagatggggcaatgttatgaggtgacagaaaaaaaagtaaaatgccttagcttctattttgtttcatttttttcttctgccagagtgaaagagcatcagactggaggggatagaacaaataattcaatgaaaacattgaactttaaaacaagaggagagactaaaataatatctccctcagaatgagttgtgttgtaagactgaagacagtctcttgatatggattctcctaaaagtcaactttgattctaggcatgggtgtaagtaatttatctgaaaagttatctaagaaagcacaagtagggaacactaaggtggggaagagagaatggcaatcaaaggcatattaatgagtggcttactcatacaagttttgtcagcctttttgggattgggatcaaagcatcagcagtttttaaagttccccaggttattctaatatgcagccaagttagagccagcgttcaaaaacttaatatttaaagtgtgttccttagagcagcagcaacaacaccagcagcatcttggaagtattgagaatgcagaatcttgggcctggcccagacctgaaaaatcagaatcttcattttcacagtatcccccagttatacacatgaacatttaagtttgagaagatttagtacttgatatggtttggctgtgtccccacccaaatctcatcttgaattgtagttcccataatccccaggcgccttgggatagacctggtggtaggtaattgaatcgtgggggtggttacctccatgctgttcttgtgatagtgagtgagttctcaggagatctgatgattttataaggtacttcccccttccttcactctgcacttctccttgctgccaccatgtgaagaaggatgtgcctgctttcccttctgccatgactgtaagttttctgaggcctccctggctgtgctgaactgtgagttaattaaacctctttcctttataaatcacccagtctcaggtatgtctttattagcagcatgagaacagactaatatagtaaattggtaccaggtagtagggtgctgctgtaaagataccccaaaatgtggaagcgactttggaactgggtaacaggtagtttggaacagtttggagggctcagaagaagacaggaagatttaggaaagtttgaaacttcctagagacttgttgaatatctttgaccaaaatgctgatggttatatgggcaataaaatccaggctgaggtggtgtcagatggagatgagcaatttgttgagaaatggagcaaaggtgacccttgctatgccttagcaaagagacttgtggcattgtaccccgaccctagagatctgtggaactttgatcttgagagagatgatttagggtgtctggcagaaggaatctcctaagcagcaaaacgttcaggaggatgcagagcataaaagttggtaaatttgcagcctgatgatgtcatagaaaaataaaaccaattttctggggaaaattacaagcctcctgcagaaatttgcataagtaatgaggagccaactgttaatcaccaagacaatggggaaaatatctccagggcatgtcagagaccttcatggaaacccctcctatcacagccactagggcctaggaagaaaaatagttttgtgggcggggcccaggactccccagctgtgcgcagcctagggacttggtgacctgcatctcagccactccagccttggctaaaagggaccaaggtacagcttgggtcgtggcttcagagggtgcaagccccaagacttggcaacttccacgtggtcttgagcctgcaggtgcacagaagtcaagaattgaggtttgggaacctctacctagatttcagagaatgtatggaaatgcctggatgtccaggaataagtttactgcaggggcaaagtccacatggagaacctctgctagggcagtgcagaaagcaaatgtaaggtgggagcccccacacagagtccccactggagcactgcctagtggagttgtgagaaaagggccatggtcctccagaccccaaaatggtggattcactgacagcttgcactgcatgcctggaaaagcaacaggcactcaacaccagcccctgaaggcagctaggagaggggttgtaccctgcaaagccacaggggcagagctgctcaaggctgtgggagcccacctcttgtacagtgcgacctggatgtgagacatggaatcaaagaagatcattttggaactttaaggtttaatgactgccctattggatttcagacttgcatgcagcctgtagcccctttgttttggccaatttctcccatttagaatgggtggatttacccagtgcctgttctctcattgtatctaggaagtaactaacttgcttttgattttacaggctcataggtggaagagcatgccttgtctcaaatgagactttgaacttggacttttgagttaaactgagaatgagataagactttgggggactgttggaaaggcatgattggttttgaaatgtgagaacatgagatttgggaggggctaggcctaaatgatgtggtttggctctgtgtccctaagcaaatctcatcttgaatggtagttcccataatccccacatgccctgggggagacccagtggcaggtaatagaaacatggcggttgttacctccatgctgtgctcatgatattgagggagttctcacaagatctgatgattttataaggcacatgcccccacttcactctgcacttctccttgctgctgccatgtgaagaagggtgtgcctgcttcctctcccaccatgattgtaagtttcccgaggcctccccagcgatgctgaactgtgactcagtcaaacctctttcctttaaaaattacccagtttcaggtatgtctttattagcagtatgagaatggagtgatacagtaccacacattgaaatcacttgtgaagttttacaaacattaatacctaaaaaccaaaggcaccacccccagaaatagtgatttttttagtctggtgtacagcctgggaaacgggcacttcacaccctcctccagctgattaaattatgtaacaggatttgatgctgctgttatttctgtttgagttagatttaaagaggtttctaggtttcttctatagtatctcaatgccccgcccttataaagattattgtgctaattgtaaagattatcatttcactttgattctttgttttctcaattaccactgaattctatgttctattttctttattgtcttgtacttttacatctcatgtttttcactcacctgccacttccttacttgatccttctacctgagactatatttacaaataattcagtttttcaccttagctgctctttagaatcatatgggaaacttaaaaaatactgatgtttgggtactatgccagagaataagattcaattatttgtggtagtttcaaatatgcctttttttctttaattataatattctgctgatgacttcaatgtgcacctaggattgagagcctatgggtttatttatcttgtctgaaaatttaaaagacaaacagaaaaggataaatggttgtatagaacttgtaaaatgcttttgtgtataaaccccttaatagttccatctgtgcattctcattttattgtttagtgctataactgtacacttttaatgtttaataaatacttggtgaaaaactggaaataaatagtactaaaaattctcttatttcattttcacaacacccttgagctagatattttttcatgatgcagatgaggttatttggtggagtaaggatctccgtgaatttatggttattagaataagatggatcatgttatcattcataatatttttcctagctaaggaacagaactggtaacacttgctccatattgctcccagggtaacctcatgtgtatcttgctataacatatgcaatctagaggtatgaaatgttagaacagttataaaattgagtgctatgtaaattcgtggattttcatgaagatgcatccaattctgggacaggagatggattacttttcctgctattaaaagttctactcaggccaggcgtggtggctcacccctgtaatcccagcactttgggaggccaaggcaggtggatcacctgaggttgggagttcgagaccagcctcaccaacatggagaaaccctgtctctactgaaaatacaaaattagccgggtgtggtggtgcatgcctgtaatcccagctactcagaggctgatgtaggagaattgcttgaacctgggaggcagaggttgtggtgagccaagatcatggcattgcactccagcctgggcaaccagagcaaaactccatctccaaaaaaaagagagaaaaaaaaatgttccactcaggctaagtgcagtagctcatgcctgtaatcccagcacattggcagactgaggcagaaggatcacttgtgtccaggagtttgagaccaacctgggcagcctctacaaaaaataaaaaattagccaggcatggcaatgcatgcctgtagtcccagccatttgggagactgaggtgggagtatcatttgagcccaagggaccgaggctgcagtgagctacgatcacaccactgcactcagcctggttgacagagtgagaccctatctcaaaaataaaagttccgctcaagttattgttgtcaatttttttagtataaaattatttatattttctagtattcaaagaagtttaattatcatctattaaataggcataatgtctaatttattggttgtaatgatatgaattatttataagctataattactggacctacaggagatgtatagtatggtaattcttagtattaatattgattatcttatcaacgacatctaataaggagcagaaatatatttactattgatatgctaatgagcatggcattcatacatgcttctagatattctaaatttattcatgtgataaaatgagcttagagtttcttgaagtgagaagtgtaaaagcctggtccctcagaatgttaaccagctttagtctcaaataattcttgtgataaaatgcgtttgaaaaatactagtttgagtaacttttagtaggttcctttgtgatggcctattcagagcctatagtgtggttttattaggaatatacaaagggttataatatagtatacagcatttcaacaacttaatttgggtattttgaacatcttattatattatggaattgatattccttggaacacattttgaaaaacatccatttaaaccattagcttataccatatcaagttagtctccagaacaactgacttttctgaaatgcactttaatgttttgtgttcagtatctctcataggtaattataagaaagatctctataatatatagcattcacctttgctatgatatgtaattttcatcaatgtacaccttatcataaaatgatctgtaggttaatttctatcgagaatttgtaggactttagttccagagatacttacaagttctctaaataagtgctatgcttttccatgctgattatgagagctatgtcgctccatgatgtttggccttccttgctcaaatatcaaaagtcaaattttatgcacacttattgcagatcgtaaaagctctcactgttggatattttaatttttcttcttttcttggaccaaatattcagagtctatactgtatttttattgtatataggttttacttgaagcccctacaaaccatttcagagacgtggcatagaagtaagctttataaatggaattcactgcctcctattttttcatgcctcttctgggctatctgtaattacccttggctccagtgactctatgcttttcattctgagcctcagctggggccattttttttctcctcaggaaatcttaccatttgagtatgaaaatgcctcttttccagtcaaagctatcagaacaaaaaccatttctttatttaactctcattcatctttgcatgaaggacgtttccagtggcagaaactcctctgcatcaaaatcattagaaataaaattgttattccaagcttctgcctttaatactttaccaaacatctattgaagttatatgaccttttctcagattaactgtagttcctatctatgatctcctgagatttcctatggaatgtctgcttctgtcatgtttttaaggattggaccagtcatgtcctatttgtccccagatcaattactgtcttccctgctctccccttcactaccggagatagaccactgaagactatatgtctcaggtttccttgtcaaaaagattcctgttgggttcgaccaagaagaggtactggcagttgattaaaacaagggaggaagcaagaagccagagtatttccgttacctctctctgattaagcagtgtctccacaaagttgttgcttctgcagtatgtttcctctgtgattctagccttcagtggaaattatcttcattcatggtcttagctcatacctttcattccccactgtgttgccttaattttgtcatgtcttcttaccccctttgttccttcagtcctagaagaagtaagaccttcctgatgttgaaaatctctggattactttgctttagattactttgcttttgtgtgtgtgtattttctatatattattttctttttttttgagacggagtcttgctctgtcgcccacgctggggtgcagtggcacgatctcggctcactgcaagctccgcctcccgggttcacgccattctcctgtctcaacctctcgagtagctgggactacaggcacatgctaccacacccggctaatttttttgaatttttagtagagaggggtttcactgtgttagccaggatggtcttgatctcctgacctcgtgatccacccaccttggcctcccaaagtgctgggattacaggcgtgagccactgcacctggccgtgcgtgtgcattttcatttcttccaacatatgtacgtatttgctatagaactatctggtgagggtttccttttcctgcctagaatgtgacttatatgagtatttaaatattatcttattttttcccagtttatgatttccttaaggaagtatatttatattttaatgaaaaatgtatttctaaaatgttctcacaaagttgtaacatatctagatttctatttttcatctactcataaataaacattaatgcattgtgactttgttatttagttgcactaatatttgtacacacaaatatatatttggtgacaaattatgacaactccttttgtacatatataagttggtttgattttgaattcaaaccagaataatggaaaccacatgtttttaagaaaaattccatataaacatgctgggtatatccactgcattgaactaacttccaaaattaatagatgtaggaaaatgccaacatcacatgcagtgatagctaagcatggctggtaattatttggtattatagttgagaaccactgattaaatatgcaatttataatgtacactgctgatataagtagttttgttctattgctgctgagaattagccatatttccatgttacatgtgtattttgcatttcatttcgataaactcttaaatatgtaatggtctcaacagttataattttcatttatcttacacaaaaataggcatcattgtatggttttgatagctggtttgtcatgcaaggttttaattctctttccttcagaaatagcatgttcatgataaaataagacagatcaaagagagtatatgtttaaaatttagtttcacggaaggaataaaaatgtggtctctgagtaattagaaagtatcattgatttttctcagtatgatgattggtacaaaatctattctggagtttctttttcatcaagaaggacttaaggtggacttagataaaattatagtattaagagcggcttgaatatagaggaaagcattagaacataggttttataaatattattaaatgtatttaggccatgtaaataatggaacccatattagcagataattttttaaattttgaactgcaattaatggttttacttttatttctttccaaaatatcagagtcagtaaataaggttataagtagcaatggtaatattggaaaagtagggacaagcttgaaaagtgaagtagagcacctttaaacattactcaaggaaaattaattaggttttcttcgtttaacttatttattattaaggaaatgtgtcatcctctgccactatccctatcacattagagtgtaccttggaaaagaaattctcaaaatagccttttttcgagtttaaatgagcaaaacatatagcaacaatgacaaaatttcacctttttaaaattctatttctggataatgtatttttctattaattaaaatgaaggttgcctttgtctctatacataaaatcactttgggatgtgtattatttcaattattgtgaaatactgaaatgtattcaactagaccatgtctagcagaccctaaattccatgttcacgacttgtgactaaaatacttgcaagaatatagaaaacaaacaagaacagaggtaggtggttaatttggtgtaagaatccacgaaaaattttcactagcatcaagaactgtgaagcaattacactggttgtaaaagaagatggtagggagctacataggcgactctctccctggtgtttccttggctccagtgaaaataagcccatgtagatatttctctgacaaatgctacttgtagtttgtagttccggaagccagattgtgaaagtggattggtgatagccaacgacattctgggaagtgtagtttttcatacacaaactgccaatgtcaggggtataatttggaaggattctggtagcagaattattctccatgagtttggaaagtcaggaagtggaaaaaaataaaacaccaaatatttagtttccattcttaataagtggatgctgcatatttttagttaaaataacttctgtgtatattaattttcctgaaatttacatttgatatgcagatactttcagctccttaaatgacaataaaagtaaaaaaaaaataagaagaagaaatgaaacaacaaacatcctatggaaacaaaaccttttctgaaacctgtgagaaaaaatatatctgtatgctattatttttctcacagtaatgtttcttgcagatggttcttggagatttgtagaggtgtaccaccttgttggtctttgacaagatccaggcgatttttctccattaccaggcagagactcgtgttctcttcccttactttctcccaaacaaatagagtctttctctctctgttctgagccacctaaagctgggaatggagtaacacaagcacctctgtggccaccacgactatgactgtgctgggtcagacccaaagccagcacagcactgtgtctcacccaaggcctgctgttgaccactctctggctactgcctatgtttgctcaagtccttggagctgtacaatcagtgtgtggcaaagtcagccaggcctctgtcttttcttccagggcagcaagttctcccagtttccagggagttcaagaggtgctctctgggagacagggactagagtaaataaccttagaaatgtacctggtattctattatactgcagctaagctgacactgagaccacaaaatggagtcgtttccacccttccatccccttttcaaaggcagaggagcctcaccttgtggccactgccaccacaagcctatgaggaattctgccagactactgctgtttcctgaagacccaaggtctcttatgtcagtttgtcatgaatgcatcctgaccagagactcagccttcaaggcagtgtgctcccctctggctcagggcaagtccagaaatgctgtccaagagccaagttctggaactggtgaccccaagagcccacgtggtgctctagctccctgtggctgatctggtcacagatcaagtccaagaccaagtgccctttacttttccctctactcttctcaagcagagagtctgacttcatagccaccacagttgagaatgtgtcgagtctctcctgaagccagcagatctcaaattatcacccaaggccctcaacgtagttcccgggtatcactgctggttattcaaggcactcagactcttcagttagcaggtaatgaatcctaccaggactaggtcattctttcccaggcagcaggctcctttctggcctgaagcatgtctagaaatgtcatccaggagctgcggcctagaaagaaggccttatgcttccaaccactactctatcttactgcagctgagctcgtatccaaggtgcaagagaaagtcctgtttattcattcctcttctctcctcaagcagaaggaagggatcttttttggagccatgagctgttcatcctggggttatgggaggggtgatgccagcactgccttagctgccaaagctgtcgtctgttgtcccagtgggtcacatgacccccctagtctattctgggcccagatcagcactaaaactttcctaaaagtagcagtcctggtggcctaggctgcttttcacatttatttagagccacagagcagtttagcccacggtggtaaagtttgtggaaactttttgagatcagtaattcccctaaggctagaggtggtttaaatgctccctccattggcaggcatctgctgagtttggtctcattttcctttctgctataacaggacatcactgagttaaatgtctcaaaattgctgtactctctctctcccagtacacaaaaatgctctccataccatgctgtgtctaccaagtggtgggagaggggttacgttgacgattcaagactctttttaaaatagttaggattcaaataatagaaaggtctctgaactgaaaaaatattaagctttccagttgaaagtattccataggtccttattggagagaaaaccttataagctttcagataacaagtaggttacttgcaagttcagaggcctttctattattttaatccctgaagtattcaatagatatacactaacacatacatgataataataaagatatatactgatttgagagtaaataaaattttataattatttacattgtcctgggaacaaaaaagagaaattctcagacatgttatgattcagaaagaaaaccatcactgtgtatcaaaaaacaaagaattaggaatttcaatatcagaaataatgccattgaaggccacatgcatcaaatgtgacaaaaacagtattttggtatcataaaaaaagatgctgtgcaaattatacatagcagtcataaaattttatgcgacaaaagacataattgtgaaaaacacaagaaagaattctccgagaaataaaaagttaaagtctctgtaatggttgtaaccttcattatactccttttaaaatttgatctgtcaagtgtacaaaatgtaagcaaagatataaaagataggaatgcaataagcaagtcagctgaagatttattatttcaatacaaataaagaacagtatatttacactaatggtattatatataatagtatatagtatatactctgaggcaagggaataattcagttaactgacaagttccatgaccttgtaagcttacattcaagttgaagaaacagaaaataaattttaaaatattttcaaaaatttaaagtttttagtaagacctacaaataaacaggtgataaaattgtatcacctgttaaaggtgataaatagagtaacaaggccccttaggtacaaattagaatggaatgcacggtgtgtggagaaagcaaggagtcagggtgaagatcacctttagttctcagcccctttagttctcagcaccttcaggggtctccttgagctgcagagctgttttcccccaatgcacacccttctcaaggtagcccacttcctatgacagatcaaggtagggttatgaaggcccagacattttggctaggtgctagacaactctgataggtgatgtactttccagagcaccccataagattagctgagctgtcaggcctggataagacttgcatttctccttctgctcaattctgagtttttctgctcctttctacaggtaataataacaagggcattccttaataaacatactgcagactacactttgcctcagcacccaacctgtaaaatacacaggagataatatatgtatataggcctcattaagctatggtagcaacttagagttttttcaaactgcagtggaattaaaagaaaaattttcagcatacttttcacatgtccacgaaatacttaccaatattgagcatatacatggccataaaaatgtaccttaataagttccaaaaattagatatcacacaggtcacatgctcttgatttaattatatgatctatgggtgcctgagtgtatcgtgaactgccagtagaatacaactgaggacctcatggtgttcaattatcttcactgcctctaccatatttaaaaatttttataatgtttcacattcataaaattattcttgacctacaaatgttcttttcttgggattaatgaatgctcatttcatggaatttcttgattcttatttaggtatttgctatggtttgaatgtcccctctaaaactcatgttgaaatttaattgccattgtgataatattgagaggtggagcctttaagaggtgattagctcatgatggatggattaatgccattataacagaagtgggttagttcttgcaggaatccaggctctgtgtcttgtgttcttacttgcccttccgtcttccaccatccactgagggataatgtggcaagaagatccataccagatgcaacccctcagtcttgaaacttcccaggcttcagaaccataagccaaataaacctcttttcttcataaactgcacagtctgttgtagttattctgttatagtagcagaaaacagactaagaccacatttattcaagaagagttaggttgtaccttttcatgttttagacaatatcctagggactgcggattgagtgataaaaataacagccttgcactgactgtctaggggaagtaaatgaaatttcaaaaaacacattcttatctagaatttttctatgttctcacctccctccctccctccctctctttatctcttgctacaaatctgtatcaataatcccattcaatttgacaaatatttattgactgcttcttaagtactaggaggcaatgacccgtatattgtgaatacaacactggtcttgtgcctttagacagagatatttactctaaaaatttcataaggtttcccctatctaaccagtagaatctttccataggtctagtgaattttctcttttctgttttaagtaaaagctcagctgtgttgatttagctcttgctacagctgcttctctgggagaaaattcttctgtcccttgtttgttgaggctacctgctcccagaggatcacccaaaacagacattcctttatgcttgcttgctgagaagtgtgtgagtgtgtgtgtgtgtaattccatttttcttctaatgagcttttagctttctgaaaatgagatactactgcgtttctgttagagtctcctcctctatttctcgggatacagaattagaaataaagtataagcataaatactaggatataattaaaagacaaataaaactttatacataacacctgggtgaatcaaaatggacattctagccatgttcaaatatctactcaattgttaccttcttcatgaaatgttttgtgatccataaataggttagaatgtctttcttcttggaatgtttatagttctttaagattttaataagatattctcataaaacttgaaactttcatgttgttgatagttgaaattaagtgccatccttcacatgacatatagattgataaagacagacattttagcctaaatgatataagtaaagatgatcaatattgcacccacacatttacataggcatagattgtgcagtggttcttgcctgtaatcccagcaatttgggaggctgaggcaggaggatcacttgagcccaggagttccagaccagcctggacaaaatagcaagatgtaatctctacaaaaaagagttttaaagaattagccaggcatggtactgcatgcctgtagtcctagttactcagaaggctgaggtgggagaaccacttgagcccaggagttccaggtagcagtgagttataatcacaccactgcactccagcctaggtgacagaaggagaaattttttttttttaaggtaaggacaaagagaatggttcccaaatttttctatagaattatatcatctggatttctttaaaaatcttgatgcctggctcctacttcaaaaattctgatttactctatctgaggtgtgagctgggcacactcaactaaaaccactaaattagggtcgtagctcttcttccacaaatgagaggtaaagatatttaaatttgtcttataagttagggtaataccctttaaactccgattgtagaaaggaatagccgtcattcttaagaaaaatgtactccaagatttggggctgagtatctgagctatttttggtgtgaaggccaactgggaaaatcttgctgaatgcctttcctgaccagataccattttgcctcatgtcaactccagaaaaaaggcctgaagctgtgtaattcaaaataatttttaagactaaagaactgtatcaattggggctgggtgagttttgctgttgggccctactgattgtgcataactaagaatgttctattgtaacttgtcaaatcacttaagttatagaaaactagcaaagatatcctctagtaacaaatagtgcacatgagtggaataggggtatgtgtggtgtgggtggcttgttcaggacctcatctttctgttgtggccaggatttcaatggtatgatcagaaactataattgccaagacaggcatccatgcagctgcatggacaggtggaacctacgagttggaatcctcaaggagtcagttgatgcacagtctagcctcatacacaagtatgctttaggcaagtcaaaaaaggtgcctgaaagctgtgggtgattgcccactgggtactggtactcaaacttggggactctttgaaatatgtgaaaagaggcaccacatgtgaaagttgatcataagaattgggtcattcttgtcacaaccaactaaaacagagttgaagcgaaaaggcattcagggtacaaaacattgctccaagtaactctttgcaagcctaactggtaaaactgcttgttgtgagctaaaaccagtttttttctatagcttctgagataacttgctgaaactctgggactaatttcgcctaccactgtaactcaccaattggagcttaccaactccccaaacccttactagtgtcaaagaactttctcaaagagcaatacgtaacatttctccttttaataaaacctttaaccttctctttgttattgagacataccaaagaccacctggtctgcatgtatgccctaccatgcaattctttcttcccaagtaaaacattaagtttagagattagtctcttcatttttattttgactctgacccttactacaggctagatttgctgctaaacaggcctgtcagcacttgtccaatgtattttggatatttgatgatgtgaccttatttggaagtcggatttgttgagaaatctacctgtattttgtacttggcatctgtgctttggggctttgtcttattcctctaccggcctcactagttattaatatcaaccaaaatttaagagaatttaagagggctgactgtgaccttgaaagcttagattctaatcttggctcagtcttttcacaaaggtgtgattttagatttcttaacctgagtatgaaataagaagcataatatacctgacaaatagttctcttcttacattaattgaaatattatagataatgcatttggtatttctcctgatatatagtaaatgatcagttattagtaatcattgattgtattttatattgcctgaaatcgacagtacaatgttttgtatatgatagctatttaataagtatttctttttgataagaactgtattctgatgacatcaacctgaaagagatgtatgtttgactgactggattgaggaaaagggtgtattttagaaagacaatctttttaaacccaaactgtttttattctaagcagcaaaatgtttccagaaatatttgagacagtacgaaagaagattgtatatttgatggaaaatgatgagatttgtagctaaaaaacatggagcaccttcaaagtgttcagaaaatttattgccctatacatttggaactaagctgatcagcaagcttaaacagtatatttatatgtacttccaatgtaagcatactgatatctcttgcaccttgagtagattttcttcctcttagtcttttgatagttaggagggaaaagaaaataacttcaagtgccattttatagttttattgcttaggtatttcattcgacttcttcaggctcagcttccaaagattcattcatctaaatcagccttaggcttcacttatctctaatccccccaaaatcatgttcagactgatgccataaagcagagatctcactttaaatttatttaaccttccatttcagaagttacaatgtgattttttttattctgctcaagcaatcacaaattttaagtttctttgagtttgttctttagtggaagcctttaggatgcacttagaaaaccccattacaagtaagagtggcaagcaaataggacacatttcctcagcattcatgtgttgctatcctagggcttacccaccttgctaaagtgttcatgacatactatttttttaaaaattgctcctgccttgaaatgtagtgctcattcttatttagcttatattttctcttttaaatgtgcctatacataactctcatgaattcttatcaactaacttgcacatcagttctgatcttcctgtttcttagatatctctcaatcagaatttatctgattaataagtgagttgaagaaattgcttttgataattttattattgaatgcttatttttatgaaaaatgtttgctcagtataaagcactgcaacacatagagtaaaaatttccttctttacagtaaaatatggacttctgtttttctttgtgtttaatagaaaaaaatactagctattcaagtgccaaaaatggtcaatgtgactcagagtttcctaatctaactgtaaattctccaacacaaggaaactaacatttgccctcccaaacactatgtacaaacaaagtatgtctttgtgaaataaattatattagtacagataggatgtaagcttggtccataatgaaaatatagatttttgagctgtttttgtcatctctcctatttaaaaaaaacttttgagaggaagcatttgaaatgtggtgttctgcctttgtcaacactgtattacaatgttctcctgtcctacatttattcagatttattagctagaaatttgaatatgttcacctgtatatccttgttattaacaattattagaataattgttcttctaattaacaattagaagaatgttttcaatatatattgaaatctttctattgaaacaattttaaaaaggtgatttgcagccaaaatggaaagctatttaattgcacaaattggtagacaggaatcaaaaaattatgataacttcaagaaatagaacagaaattctaggactctaccaatcattatgaataaacctaccaagaaaaggcagcttcaagttcaactgtccatgatgatacagactaaagaagaagcatgcctgcttttccatggcaactttcccatatgttctcattatttttgttttcttaggacatttctcttctggaagtggctatggaaaaagcgacatgctatggtagacatgcagggtctcagaatacttgagtcttggctttgccacatttaggtcatgtcatgcctgttacctatttgtaaaattatacctgtcccatctaccttaataaattgttataaggatcaaatgacatgtactttatgcaaattccttgaacattataaattgctataaaaatatgaggaattattattctgcacgaagcttttcccaatattgaatcttagtaattttcaacttgttaagtcaaataattaggtatcgattaaatatactcgaggcattattactttttgctaaatgcttctatcatgatccctaccttttgattagcttctctcaaaccccttctgggcttggatatgtgacttgctttggcatatctgatatgagtaggcatgacgaaagcagaggattgaaatgttcttttgcattagtcttgccctcttgatgttctgccatcaccatgataaaagctggtccagctagcccagatagcctgcgggtctcagaagaattaggggcatgtgaagcagacctcaaccaatctgagccctggagataaagcccagattaaaccagcctaaatcatctgaatgccaaacaattcacagatgtgagaatgtaaaattaatgtttcttactataagccacagagtggaatgacttgttaggcaaaattatggtgagtatatattactcatacagaaatgcatactagaggcaggagagtgccatcacagaaacttaattattgtgtttgtttgtttgtttgtttgtttgttttggaaccaggtagcaggcaataaggaagctcacttagaagactgggataaaggcaatttgtattatttagaggcaatgcgttttggtaaaagagttgcttgacataatgtgtaagatatgaaatgaacagaatgaccatttacactgggtgagggaattttctaggcagatggctaaaagcataaactgattgctgccagttacgtataataaggcactaaaagagaaagatgagaaagtggaaaactgggtgatatacaaacaaaaaatgatgttatgacacagcttcaggttaaaaatcaaacaaatttagactaatgcccataagacatagcgaacaaaataaaactttatgggtccaaggtatgtataattaagtcttgagagagaggcatgtagatgtgtggctttagaacatggcaatcctgtgtttaaagccagtacatagaaaattcaaaaaatatacactcttacagattttaaaagattacagaaaatctaaatttcaactggcaagcattgaatacaaattataggaggccatggttttggactaaactcccacattaggcacctacagactagactaaaaatcaaaatggggtcacccatgcttaagttccatatccccaatcccaaagtaagttgttatctgacctttcaagaaatcagatgtttgcagatgacatcctatatagagaaaatcccactgtctcagcccaaaagcttcttaagctgataaacaacttcagcaaagtctcaggatacaaaatcaatgtgaaaaaatcgctagcattcctatacaccaacaacaggcaagctgagagcccaatcatgaacaaactcccatttacaattgccacaaaaagaataaaatacctgggaatacaactaacaagggaagtgaaagatctttacaaggagaactacaaaacactgctcaaataaatccgaggtgacaaaaacaaatgtaaaaacattccatgctcatggataggaagaatcaatatcattaaaatggccatactgcccaaagcaatttatagattcaatgctattcccactaaactacctttgacattcttcagagaactagaaaaaactattttaagattcatatggaaccaaaaaagagccaaaatagccaaggcaatcctaagcaaaaagaacaaagctgcaagcatcatccaaactgacttcaaactatacagcagggctatagtaaacaaaacagcatgatagtggtacaagaacacatagatcagtggaacagaacagagaacccagaaataagaccacacaactacaactatttgattgttgacaaacctgacaaaaacaagcaatggggaaagaattccctattcaataaatggtgctgggacaactggttagccatatgtagaaaattggaactagacccctaccttacactgtatacgaaaaatcaactcaagatggattaaagactaaaatataaaacccaaaactataaaaactctcgaagaaaacctaggcaatatcattcaggacataggcacgggcaaagatatcatgatgaagatgccaaaagcaattgcaacaaaagcaacaactgacaaatgggatctaattaaactaaagagcttctgaacagcaagggaacctatcaacattgtaaacaagcaacacacagaatgggaaaaaaattgtgcaaagtatgcatctgacaaaggtttaatgtccagcatctatatacaatttaaacaaatatacaagaaaaaaaccaaacactcccattaaaaaagtgggtaaagaacatgaacagacacttttcagaagaaggcatacgtgtggccaacaagcgtgtgaagaaagcttaacatcagtgatcattagagagatgcaaatcaaaaccacaatgaggtatcatctcataccagtcagaatgagataatagccaatttcccaaacagggcagtttaaatcttcaattgtcatgataataaaatttcctctactttaatccttacacaaaaaaggtagcctagtgtaacctgatgttacctaattttttgcgttgttatgtctccccttccctgccttacaagaaaagtagctttagtaggactaataacactatgtgttacttgtttctgctttcttcaacccttctctgtctataaagtcacttcttgtgctcaactcatcagaacacttattctgaaatgtatggaatgaagtgttgcctgattctagaattgctaaaaaagccaattaagatttttaaactaaatttgttgtaattttgtcttgtgacagaattgatgaccaatcaagggacttgataaagacttctgatagccctgagaccccttgaggaacacacataaaggcaccactaatcccctttgttgtgggtgatggtattttttcttcctcatggggcccagagagccccaaatgcctctcaggtgtgagctctgctgttttttgcgtttgaaccctctgatctttttgtaatcatctaacaggttcttcctgcccactgaacagacaaaaccaattcactgagacaatgctattgcagtaagaaaagaatttaattaacattatgccagccacatggcagatgaagttattacttaaatcagtctccccgaaggctcagaagttagggtttttgatgaataatttggtgagcagggggctaggaaatgggtgctgctgattggttggagatggaatcataggggtgtgggaaacagtcttcatgcgctaagtctgcctctgagttggggcgggggtcggggtcggggtgcacaggaccagttgagtcatgaatcacaagtctagttggggtcagtctgttgccagaattcaaaagtcttaaaaacatctccaaaagatcaatcttaggttctaaaatagtgatgttatctatgcaatagtgagggagttctcatgagatctgatggtttaaaagtggcagttttccctgcacactctctctctcttcttccaccaagtaagatgcaccttgcttccccttcaccttatgccatgattttaagtttcctgaggtgtccccaggcatgtggaactgtgagtcaattaaaacccctttctttataaattacccagtctcagtaattttatggcagtgtgagaatgaactaatacaacagtctattcactctctgtctgaattacattttttcccctgaaaagaaatgttaaacactctccttatgatagaaccacacaaaaattcaggaggtaatccccaagtgacttaccctccctagaaaaaaactgagttcaaagccatagttaaaaattttcttaaacttacagaaaaccttcaaaagttttctaaagaattgagggccttaattgtaacttttcaacctgaaatacctgacctctgctaaccatacaacatgttggtgagaactggggagttccaaaaaggataaaaaaggcagaatagtgttctcctgagaatagtattaaggacccaattgcaaatgattttttgaaagccattcccggccgggcacggtggctcatacctgtaatcccagcactttgtgaggccgaggcgggcggatcacaaggtcgggagttcgagaccagcctgaccaacatggcgaaaccccgtctctactgaaaatacaaaaaaaaaaaattagccaggcgtggtggtgggcgcctgtaattccagctactcaggaggctgaggcaggagaattgcttgaacccaggaagcagaagttgcagtgagccaagatcgtgccattgtactccaacctgtgcaataagagcaagactccatctcaaaaaaaaaaaaaaaaaaaaaaagaaagccattcccaaagtgtttcagctccatggcaattaacaactgagaatgacttttaggcctgccctaggccgcttgtccaataagcaacccataaaacaacagtttctaaagaatttttgccatttgtgcaaacaaccagtaaattggaaaagggactaccccaaagttttcaaagaaagcccctgaaaacaggctactaccctctgataatctccgtgataaacaccaggactgagtggcctccaagggaagctcctgcaagtttctattggttatgctttgccctgcttgttaaagggctcagccttgaagttggtaatttaatgtaaaaataagcaacattaaagtgaccactattaaactgaatggtctccaaaatacaactttctgacatttatctagctattttgaaactctttgtagaagatatttacacctataaaggcaatctccatttataagggcatttcactctctgcacctaaaacactagaaacttttacaatggaaaatacattggtttaaaatttatacaacaaaccttacctttctttaaggtacatttcctagtcggcttgtcttaattgggcctttatctacacctttcttttttctgcaactaatagtgtttagatctatgttctgtaaatttgactacatggtttcatccgggatgtttgtctaaaggagggaaactgtttgaaaaatgacaaagaatcttattggagctataagatgtgcatctgaaactgcctttgaaaaaattataactgaggaaattatgacagtgaaagagatcagacctaaccaactatatcttgcttctaacctttaagctttccttgttcattcctgggtgtaggcagaactaactttggaaaggaattcagttcatagtttgaaacaaaattgatgatagccctttcctgaaaagagctccttttgtcttggggactagtctgccttctcaggactaacaaattggctacgagattagaaattacagtttaggggtaatgcagcctctggctccaagagtcttgtaaaacctaagaacagtgcttgagctattttgcagaccctgcactggatggattatctgacaccacccaggtcagtaatctggctcaaccagttctgccatcctacccaagaacagaggacggcaagaaaaactcacttcaaccccctatgattccatctccaacctgaccaatcagcactccccacttcccaagcccctacctgccaaattatctttaaaaactctgttacctaaatgttcaaggagactgatatgaggaataataaaattcctgtctcctacacagctggctctgtgtgaattactctttctcccttgcaattcccctgttttaataaatcagctctgtctctgcagcgggcaaggtgattgtgttgggcggttacacttctgcctgagtgtctgtatgtctacatgtgttatgtatatgtgatacttttctgccaaaatgtgtgagagagctctaattaatttacttaaagaaaaaagtaagtgcttaaataacatgttttaccataaaaaaagaacctaactcaaatgctttggttcgtgtgacttgggtaaaattttggtaaataagactggaaaagagctgtgtcttctgatcagaaaacaacatatatttgactttaggaggtggtgactgcctaacttttacatgctgtagaaaatggctaagagggaaataggttaagatgatgtaaaccaaaaataaaattctaagattccccccaacctacagatagataccccctttagtccaagggcatttgaaagtaaaattgaaaatctagttcaggatctgacatgcctcattataccctcttctctttggaattcaggaacaactgaccagcattaacattaaaactgagatcttaagactgacaaaacagactttttatagcaataagacacccaattcaagcctgaatctagtatagcatcacataacagaaagcaagccctgaaagaagtattttacccctaaatatatttatttgacatattttgaaatggccctgcaaagctgtttcttgtgaagaaaacctacattctgtacagaatcccctttcctttccaggtctttcctctgatccaggagagaattaattaagactcaggcaactttttaggtctaattacagctctgaagactgctacctggaggtttcatttgcatgataaaaccttggtctccagaaacccttatcttaaccctttctactgattccagctctttagataatatctctttcaactaattgccaatcagaaaatctttgaatcttcctatgacctggaagcccccaactccctgtttctagttgttctgcctttccagaattctgggtgaaccaatgtacatcttacatgtattgaatgatgtcttatgtctccctaaaatgtataaaaccaatctgtagcctaatcaccttgggcacgtgttctcagaatctcctggggctgtgttttgggccatttctcactcatatttggctcaggataaatctcttcaaatattttacagagtttgagtcttttttaatcaacaataatggctagttttgtttcacgtctcataaaatttgccaaaagagttctaacataattgttaaaaatcagtatattaggtaagtatcaatggcataaacattcataaattcttcataatttaaaagcaatttttttttgataatgtaaactccaaatatctgagacaggtcccagtcaatttagaaagtttattttgccaaggttaaggatgcaatctcaggaggtcctgacagcatgcgcccaaggtcgtaggggcacagcttggttttatacatttagggagacatgagacatcaatatatgtaagaggaacattggttcagtctggaaaggtggaacaactggaagcaaaggcaaaggcgggacaacttgaagtggggagggtgcttccagatcacaggtagataagagaaaaagggttgcattcttttgaggttctaattagtctttccaaaggaggcagacaggtacgcatttatctcagtgagcagagggatgactttgaatagaatggaaggcaggtttgccctaagcagttcccagcttgacttctccctttagctcagtaattttgggtcccaagatttgtttttctttcacagtaccatgaaacgttaaagtgaaattgagtaataggtactcattaaatgtctgggtcattttctaaaaaagttaaaatacgaaaacattttgattaagcctaagtgtaaagtttatatactttggcattttgtttttatatggtatagagcagctaaatatttgagtctataagtaaagatttttttaaaaattgttctgtgaggaagtgcatgtttctaaatattgtaaaatatgcatttaaaaaatgttggtttgatagagttcaaaattgcttatttcctaggttgtcacaaaaaattaaagttactgagagttaagaattctaactatatgtgtaattaaaactactagaagtagggggaaaattctgtatgcaaagtatagaaggaaagtaagatgtgtttttgctgagaaaaattgtaaaaaatagaaggatatatttttgtttagaaagagcatttttttaattcagagattattacagattgttccaaaatacagaattgggaaggaaatagaaacaaggcaggaaggtactagttagtaggagagatgtgaaaagaagttataagtatgaggaggcattattggtaaagagggatgaaaagtgagagtaatatttacttttgtatgagagaaaactttgcatggttaaaatgatgaggaagaagggaaaataggtgtttgtcctaatatgccaggccaggtctccattagcaaccagagccgtcagcctttaccagcaccttagtgtcactctgatgaatgtataagttaaacattaaagaactggagaaactggtgccttagtacagaggctagaatgtaaaaacaagtccattaagatactgtctgggctttctcagaccttagaatttaattaaaataatggagacatacttgcacaccatgtaccaggacccactttagattaagtaatttttccaagtctctgaagtaattgtccagaccctggaccctagttaaagatgagatagagtgaaacactttggctttcggcttgtaggtgcactgaatgtatataagcactaggaaaaacttgtaactttgagttggtctggtgggttactccaacctcctccctgtaaccagctacagaaatgaactcccttctttcccagtctgtctgcatcttgttattgaaccgtgagagcaagcagccggaccttgttctgtccaggaacaaatctagcaagccagacaggagggagctgccctcagtggccagcctcttgcaacgagatggtcactgggaaactcccagcacctgccaggtacagtttgtcctgagcttacctgatgcaaagactgcccatccttctattgctgggtaagggcagaggttaggagcaaacatgcttgaaggatcattcaaactggattgtaagtggattgtaagccagaagactattatttcctctatttgggctcacgtagccatttgttttggtaccattgagaaagcaatatgacttgtttgtgtaactgctttgcatttgtttgaggattcatttgcatttgtttgtgaaaatttgttctgtttgtctgatatttgttaagtttagagtactcactatgggcaacactgcatctattcctacaaatagtcctctggggagaattttgtcagattggaagcactttggttatccacccatgactaaaaaaataatctattgtagcagagcttggtcaatgtatgttttggggtctgtgaaatggtggccagttttggatctctaaattttcataccctctatcaattagaattgttctgccagaggtcaggaaaatgaggcaaaatacattatgtccaggcatttatgttactgcttaataaggatggtaaagaaaatggaaataagctaatggtgcagtacactgctaaagtctgtcccgactcccaaggggagagagaaaaaacctctgaaatccaacagttaatgaacactctaaaccccatagtggctgccctcccatctcaggaaagagaaggaatgtcactgccagagtacagggaagtagcagagctactgtcttcttctcggactaaccaaggtactaattttggctggggagtcaccgagtccaaagcagggctattcccactacgataatacccagtaggagtcaatcagcaaggagttccagccagatgttattgggcctataataccactatatttgctacacaatgtcccacctaagatgtgcaggctctcctaaacattaaggtatctggttttaaataaagcaaaggaagaggcgcaacatcttcataatgaaaatccaaatgacactccagatcctgacagggcgattcaccacatggacccaaattgggatattgtagaggacgtacatcgcagtgtaactaacatgtatactaagttcccttattttcctggagatcataaagggtttatactattggatttaaaagatgctttcttttgcattctcatagacacagaaagtcaattgttgtttaactttgaatggacagatcttgaagccgcaatgcagtttcaatattgctggactgtactcccaccaggatttaaaaactctccgactacatttggaaaagccttcgtttgaaatttaaggagtttaagattgggaaatggaatactgttacaatatttggataatttactaatagctaccccatgtgaatgggaatatcacaataatactattaaaactttggaccatctagcaacctgtgggtataaggtttcaagtaaaaaggctcaaatatgccaacaaactgtgcaatacttaagttttttcttacagaagggaaccagagctctaacaatggaaaggtaaaatacaatcacttccattgcagcacccactaccagaaggttgctgagaggatttctagatgtggcagggttttgtctattggatatggattcctaaccatggactactggtaaagccactgtttgaactgtttaaaggagctaacaataacatctttgactgggagcaaaacaccagcatgcattcaaacaactgaaacataagttaacccccaccctagccctggggctcccaaatcctcataagccatttcaactgtgtatgcatgagagactgggtctagtgctcggggtccttatgcagaagttaggagaaataagacagctggtggcctacttttctaaacagctggacacagtggctacaggctggcccccctgtctgagagcacttgccaccaactgcctattattaaagcaggctgaaaagctaaccttgagaaagcctattacaatctacatgcctcatcaggtactagtgctactttagcaaaagagaggctattgactgacagctgatgggttaggcaaataccagggcagactcttagatgaccccactatgaaattacaaaccaccagagctctaaacccagctacattactacatcctaccaaggaatcagaggaccccatgcgtaattgtttggaaatcattatcaagtgttttccagctgccctgatttaaaggatacggacttgctgcatgcagactggatattgtttgtggatgggaacagcctggtagccaatgggaaaagaaatgctgcatatgccatggcaaccttttcagaggtaatagaagcaaagattgtaccaatgggaacctctgcacagaaggcagaactgattatccttgtgagagacttgcagttgtcccaagtatacaaggcacatggaataaattggagactacagtcagcatggagaccacaatcttctggacagactaaaagtataaatcaaacactaaaaacaattattgccaaactgcgccaggaaattcaaccaagataggctcaggtagttggcattgcactgctccaggtaaaagtgaccctcagaagtaggagtaagttaagtccctatgaaattatatattacgagaacctttgccgctaatctgtctctggttactagggtggtccttaatagaaagtcaactattaagcaggatgttgctcatttgggacaaattcttaacattttgcataagcttgcttccatctggagcattgtctggtgatcaagtactgctaaagaatggagggcccaactcaacaactacaggagaaatgggaaggaccctacaacgtgttgctgaccaccaattcggcactgaaactggtgggcatcaagccaccacatatgggtaaagaagtttctactagatgaaacatccatgacagaggacaccaaggcccccaaatgggagttggaacccatggaaggcctaaggtttctgttcaaaagatgataagctattcttttataatatttttcttcactgttcctcttgttgtttctgcttacacctctaaccttttcctataatgggcacaagaatatgcagatagcctacagcaagactcttgctggatctattacccctctctagtaccacaggactgctttggtgggtctccccccatacaaggaaaattgggttacttcctagaaaatcataaaaaatgggcagggtcgcaggtgagggggataactagaaaaaaagtatttctgaatggcctataaataaaactttaaataatccagggcacaggttccttcttgagctataggtaaaactgaatgttgtatgtatattcccaataactcagaaaacatttatttagctttaaagaatatgaaccaacagattgaagccctctatagctctgcactgtctctcaataaattaatagcatcttggttgggtgaaggaccttcttggtggcagaaaattctggttgtcctagccaccctcttgggcataggcataggcataacaccatgttgtggactatattgttgttgtacgctgttccaaaacattccctgagctcataaaatcatgtttcaacaggcactggctttgagtccccgaaaccaagaacactaccaatggcaagtagatatttaacactccaatgtctcttgacgatgaccctcttcagtaggaagtagccagagagaataagtcatccacctgcccttactgctattatattatagcttatactctgtactaacccataatagattaatgcttgaaactaacatgatggaaatcatgcacaaattgacagtgatgattgtggcaggccgggtctccatcagcaaccagagccgccagcctttactgacaccttactgtaactctgatgaatgtataagttaaacattaaagaaatggagaaactggtgcattagtacaaaggctaggatataaaaacaagcccgttaagaccccacctgggctttctcagacctttgagtttaattaaaataatggaggcattcttgcacactttgtaccaggacccactttaagtaatttttccaaatctctgaagtaattgtctaaacagaccccagactccagatgaagattacacagagtgaaacactttggctttcagcttgtaggtgcactgaatgtatataaaccataggaaaaacttgtaattttgagttggtatggtgagttactccaaccttctccctgtaactggttgcagaaatgaactcccttctttcccagtctgtctgcatctcgttattggacttcaagaataagcagtcagaccccattctgtctgggaacaataaggtagaatgccaagatgttttttataaaagaagtataagacaaaaccgaacgtttaagcaagttgtagaagatttgtggaagataaatgtcatgaaagaaattttatgtgtgatcaagatgggtaaaatgagaagggaattatttatgtttctttctagaaattgaatgttaatatcaaaatacactaatgcaaggataaagtttgagcccatgtgttggaacaacagaattttttcagagcattgaaacgctctttaagaggaaattttgagaggtctatttttactttttagataactggcctaggaggcagagattctattttttaagataatttattgtgctttgtggctttaaatattttagcagtttggtttgatttcctagtgacctatgatcctattttgatcaaatgttttaaatctttgatatttgacaaacttctcaaaaatcaatgttaaatcattttaatctccaagcaaagttgggacattccagtgatacctggaatttctccaaggatctgtaaaagagagatattaaacctgttgatttaatgtgatacgttaaattacatgggaagcattgacaaaataaaaaatgatgtttaagcttctacaagttatattaatataaatatgttattaatatgtgttctaaaactgtataaagttcctagaaatctaatataacttggtagagatgctattagtcataattttgctttagaaataacaaaatgtcttggcaattgtgttattattataatgaactctcatcaggtttttagccatgtccattgtaattcttgatgtctactgtgaattcctttattcttatgcttttctgaaagcttcttgcaagcaattataatcctgaagttttctgtctttaagcagcttcatggaaagaataaaaaaacctctgaaaagtacaagtttctaataagtttacttgaattttcaaaattctaatgaagaaactgatgggtttgttaaactgctaaacaagaacagagctagaattaattacatgagacaataaactgatgaccaaaaaatgggcttttaaggcttcatttcaaaccttgctggttctgttagtgttttcttttcaagatttaagaagctgtttcctttaatctctctatagcttacaaaaatttggaaaaacatacttttctaaacaaaaattgaaacattttcttttcctctctccttggtctcttcagaattcagaaagtatttgtgagtattcttatttttatggcaatatgattatttgtataagttcaatacaaaatatgtttttttataacaagatactcttgaaaacattgttatattgccaaggctttgactggaacgttatatttgaaaatttcccatttgagaatgcctggcttcaaaaatttctggccttagagtgagtgggcaaaagttttcacttcctggaaggctcagaaacatcaagacattagatacagaatgaaacattgaatgtctgccttggtttggcttattagcattgagagatttttaaaagttcaatctgaaattccttgtcaaaacttccagcatggcaaattttaaagggatgtatttaattattcttgccacataaatacataaataatcaggctaaatttgacactaaatttattttgcaaccactttcgtcttactatgatcatctttggtagaaatgggagtcactatagagataaaaattattttccaaaagaaaactcagtacacctgttattagattgcagtgctgttcattgttttttagtttttcctgtctacttataggtaactggattctaaattctaaattcttctacttttctctaatatatggctacaactttccaatgaagaatgaaaactgctcagttactgaagccctataagccaaaattggacaaattttatgtaaattacaaggaacaagtctcatgccagatctgtgggttccatagagttcaccagaatatcctatgccacaactggagacatttaaacttcaaaccaatacaagaagttgctgacttcatgctgtggacagcatttccaagaccatcagaacaagattttctgtcatgttgagactcttacccctcttaatatttccttatgcctgcctctttcacttggcaggaaaatgctgtagttaaaatttcacattcagtagatttagcaagtaacttgtacttcctgctttaatttaacccagtcatgggatgctagattacctattattttcatagagagaaatctatgcagatgatgacctttattgtcaacatggataaatacagtgggtattatagagtggactacttggttcaaatgtgtaagctccttgtctggttatttaattttagttggcttggttcacggggacggtggttaagaagcatactccaaactcttgttattatcttcctggtagtcataacagtagtcttcctggtgtgccgtatccacctaaaaagttttgaatgtttctatatagccatcggtcaaacatcaaatattctctctctggctataacaacaaaactcaaagaaatgcataataatgaggaggacactgtaacccataaatgacatgctaagacaacaaacacaaaattatggtaaccaggagtagcaatgatgtcctatggtgatgtctcacctaggtgagaacctggcagaaagaagggaattgtaaaataaaaattttaggagaccattattttggactaagcttctgcactaggccttaacagaccagactagaaatgaaagtagagccacccgtgctaaagttctatgttaacatacccaaactaagttcttatgtgaccttctgagaaatcaggaaaaaaagagataacagccaattttccaaacaggcaagtttaaatcttcactcagcataatggagttccctttgcttaatccttacacagaaaaggcacgtgttggtgatcagatgacccccagaaaaactgcagatgcgtaagtgagatataaatgattattcttacattccactgagttttgggttagtttgctttatagcaatattaagctgactgatagaagcatcattgctagactaaatttttataaatctggaggaatttaatggatttcaaattgttggcctgtaaaatgaatgaaaaatatgttcatagtggtagcacatcgtgtgctggtatgaaaggttacctaagttttgagtcaaaagagtagggttccagaaacagtatgtttttttatattgggcttttataagttctctcaactttttttttttttttttaccattttgatatgttagtctttctaataaaatgatttgccttttagtgacagtattgcatttttgataagataaagcacaataacctgaactatctgaagaaacaagcatcatagagccataattgctgtgttaaaagttttcctagaataaacacaaaaaataattgaaatacctatataataagtaatattaattacatagagttaatggactggaggaaaagaagcattatagttattaaacatgatatctcaaattgtttctggtagaaggtatccaagttactggcagtgaatctgtacgagtctacagcaacaattcttgcctcctcagaagaaagaatttgactgaggagcacaaggcagaaaaagagaccaaggcaaatttcagagcagtaatgaaagtttatttaaaaaggatttagaacaggaaagaaaaaaattatgctgggaagaaaaccaagtgggcaacttgaaggacaagcgcagtgctgaaccttgatcctaggactttatagggtggcccaactctggcattttgtgcctctttcccatgattctttccttaggctgggctgcctgcacgtgcagtgccctccttatcctttggaagtgagcacacacagtgtatttaggaagttgtgcacatgcccatcggagactttcttcccttttccaggggagtgccaccagaagatcatacgctaccattttctctctttttctttgtcttttctttctttctttctttctttctttctttctttctttctttctttctttctttctttctttctttctttctttcctttctttctttctttctttctttctttctttctttctttctttctttctttctttcttttcttttcttttcttttcttttctttctttctttttttttgagacagaatctcgctctgttgccaggctggagtgcaatggcgtgatcttagctcactgcaatctctgcctcctggtttcaagtgattctcctgcctcagcctctcaagtatctgggattacaagtgtgtgccatcacacccagctaatttttgtattttcagtggagacgggggggtctcaccatgttggccaggatggtctcgatctcctgacctcatgatctgcgcgcctcagcctcccaatgtgctgggattacaggcgccagccactgcgcctggcccattttgtctcttaatgcacatgcccaggaagttgtttctccctggagcctgcattcaattaacacttaagtgcaacaggtgtggaccatcaggaactggccttcccctggcaccagctgccaattatcattttcagagaggcaatgtgataattgtcgaaccatcacctgattttcctggtgggtgggggaagccttcctctgccctactcatgcctatctaactgtctgtaacattccccctgtcaagagcccaataccccacatctttggggtaaacttggtggtcagtgttctataactacctcccactgacaaagtggtggtgattctctgggtcttggcctcttgctagctgtgagggcaggagggtgactctgtgtgttggtgaaagcagtgtatagccaggtcaaagggagatgggcaggatttcacatccttcctgtcccactgatgggcagcctaggggtcccctgtagaagggtgcctcttgaaaatttagaggacagtatccctcactgagaatcttctggagcatgatggcctaaagcagaggagacaaattaggttattataattagaagaatgttaaaatgaaataaggtagtgaaaacagctccaaaaaatcctgaggcagtcaacactacatgctaaggtaactggtagctatagacatgcctgctaaaacttggatgcattgagctgctagccaattccaatgtgtgcccgtaattagaatattatctagatttttacattacccatcctgtttatttcttctgagctgcagcaagagatcactggttggttcacaggaataagcagggttgttctaaaatgcagacaaaaacttaaaaacaactgatgagactagaatctaatgataggtgtaccataacttttgaaacataatttctgtctctctagtcctcatttttgttaaaaacaaatcatgataggattgatttgtccaaaaaataaactttagtcttattatacttggcctcattattatcataaagtgcaacaagaatagttatttttcacataggcttttaacttggctttgatggaactttgttccatagaaggaatctcagataagacttttttaaaccccaggccggccatggatttgtaccatcaaatacctagtggggtaaatttctcttctcttgaggtcccaaaataactttgacctcctgatctgttagaaagtgacattctttacttaccacaggtcagcaactctgtacaggactgtgtagacaaggtatgaagccaggtttcccaaggggtttttattggctctataagtcaaatttgattccttaaaggaaagcatgccattccagtgaaagccttggtaagacaacccttttctccaattgtcctgttacaaaagaaaacattctcatgcacttatgcaaataaccatattgccgtaagttaagaatactcacacatagtttccaaattatagagaaatcaggtagagagaagcaaatatgcaacaaattttgttcacaggaatatcctgtactcaattgctacaatctgtcaattgctcaaaagaaaagtttccttgactctgaaaaacaaagcaaaggatcagcaacattttaaacaaaaagtcaaaaaagattacttcagtcttctgttaattcacttcattcagttaactgctattctgctttatattcatgaacattttagctctccatgagagtcatgaaggatttttcttttattctaatgtcacaatctccaaagttatcagaaatctgcatttaagaacacctgttaatgttgtatagctgattataaaaccaccatttaaagaggattaaaacaagacaacaattgtctatgaatgaccaagagtcttagggcagccacagttaaagaaacaattgacaaagaaatgtgttacctctgtggcacacaacagttttacataacaattttaattattaataacatatactaagttgtattagaattccatagttttggagcacataccaataacatatttatatgaatacagctcagagaaagaactcttagcaacttttggtgaaaaacctagttagtaagcaattttaattatgtgcttggtttggagcagataagaggtacagataagatctgactcttttgagaatagctaggggtgtggctaactccacatatccccaggtcttacctacctgtaaagcaggcaagttgtatagttaagattcatagtgaagcattgaggaggtctaataacaattaaattgtataacatttattgtataaattacctttcatgaatcctttcacggcttacactgaccatctttgacatgctcggacattctgatttgtcctaaatatccctctttttaaacaaccagtcattttactttaggacaataagattccttcttatataaaatctcttttctttataacctctctaccaaaaatacctctttgcctttataacctttgaattaggcaaaagtcattttccttctgttaaaaaattaaagtttgtactgcacattgctatgcaggccctgtgaagggagagtaaagacattatctacatactgtagaatttagctctcctcaagtgattacttggttagatttttgctagggctattagagaggaagatgaattggacaaatattaagtgaacacccatcttggagggtacatttttgcaccaaagaggtgaggggtagccagaccttacaaggcactgttgagagaatggtaattggtcccttaagtgatataaaggggtgtgaatctctttttgagggaggggatgctatttgcctcacccaacaggtttatccctgtcctccttattctgctctcggttataaaagactaaagaacctaatctgaagaccccctgcacaggagcactgtgttgcaaggctgacttttgtaatttcctaccagttcatttttaagccaaacagtttaaggttagggaaaattaaacttttcccatttttagggaatgcatccaaggggtgtgtcctgtggtatgaagacacagttactcatctgccatttgtgaagagggaacagaggggaaaaaaagaggaaaaagaaaaaagaaggcatctcccctttcttcctattatcccaaatggggtgtcccccatcatcctgggttctggacttaagcagtctttaccatgtaccattggtcccatcttgtcacaattacccacttgagaacagaggagatattggaatgaacagttggtccctgttcattcctggagtttcagaattaagtggtcctcactgtgtaccaccccccagcctttcatctctgttctcatggtaatctgttagcctgggaccacccttcatctctgttctatgggtctcttgcatctgtggccttgggccagcctccttgtctccataaccttagagtgaccctcactcagagcattttacgaataaaatgattatcccttttcttagaagaatgtttctccattaactgctgcaaggactggacttctttccctcctcccttagaatatgaccttgaagatcttgatacaggttgagaagggcatggaagtaattagagaaatggaggctgcaggaggaagtagaaggaagtgagagaaatattcatggaaaggcttcatatgctcttgaaaatagctgctcttggattccagagggtcatgtgtattcaccctctggacataaagcagtaacctccggaggacttggggcttggggtaagaatttctcctcttcccaaagtcgtgctggctaaaaaggcaagagggtggaatccttaaagggccagagtgaagccacatgcagccagacaagcttgttatgatagctatcagaaaacttagcccttgggcataacagcaatgaaaagcacctggtgagttctaagaagctggcagagctgaggttccagttagtgtcctggccatgtgccagcagggatgggaaggattgaaggtcatctgaactggcaaaaaacaaatataaacctccagaggtattcgcaagggagtccatgactttgctgctgcacaaacgcagagaaccatgggggcatcaataacagggagtgtgtatttaagaagtcacatggcatgcaaagtaaaagcaaagaagcaggcttgtccccaaggtggaaggtccagtggatgtccaaagccatttcagaacacacatacagagaaaacaggaaattgagcagttcaggtttttggaaaagagctgattttagatggaagaaataaaagcagaagcatccccagacattgcatagtttgtaagccttagcctcaccactctcaggaccctcctgtctaagagggccatttagtgcctctaatcttctcattgtgaaccctaaggtctttcctacccacaggagccacctataagggtgagctgagaaatttgctggggaaagcatcgtcacctaaggccaagaggaattgttctgggggttggttagtaagcaggagagagagagagagagagaggaaaaaccacacacggagttggatgcctccagccaaagaagacgaggcatagagatatcttaccactaaggaacatatctgagtcacgtggcaccaaatatgttagtggtggcaaatatcaatatctgagtcacttggcatcaaatatgttaccagtggaaggtatctgtgttaccagtggtgaatctgtataggtcagcagcaatctcaattcttccctcctcaggagaaagaatttgaggaacatattctccaaaagagaccaaagcaagtttcagagcaggagtgaaagtttattttaaaaggctttcaaacaggaaagaaaggaaagtatgcttggaagatacccaagcaggtgacttgaaggacaagtgcagtgttgaaccatgatcctaggactttataggctgacccatctctggtgttttgcacccctttcccatgattcttcacgtagggtgggctgtctgcatgctcagtgccctccttactgtttgaaagtcagcacgcactgtgtgtttaggaagttgtgtgcatggctatctgaggctttttcccttttctagtggagtgcccaacagaagacgattctctgccattttgcctcttaatgcacatgcccaggaagttacttattcctggagtctacattcaattaacactttagggcaacaggtgtggaccatcaggaaatggcctctccttggagccagatgccaattatcatttttagagaaccaatgtaataattgtcaaatcatcacctgatattcctggtaggtgggtggagccctctcctgtctaactacctgtaacaaaatgtatttgagtattgtcagcccaatcatgattttagaaatggagagattcttcaaaagacctaaaaatcaatgttaaaaaaacctattttcctgtaacctatgaaattagtataaaagaaatatttaaaaaattgtttactttcataaaatttagctattatatgtaatttatcttgacattaacactgtgactctgaagcaaaacaatgttagtggcagctgaagttttaacttaagcaaaatgtataggtttaattgattttttcaaaattttattaatagcaaagttgggaaatgtaaggtgggtaataaatagaatcttataattttttctgtgcaaatgaggatgttttaaatattatttgtcttcatcttttaaatgctagcataaaataaaaacaatgtactagacatgttctataaacttttgtaaacaaatttacatttgttaatatgaaataaatggtaacatgactaattttagaatctttataatgttgcaaattgtgtattgatatacacaattacaggcatgagccactgcacccagccttagttttttttaatcatcagtttaaaaatgatcagttttattacaaattagtaattttacaataatattaaggggtttaagaggctctatttcttttattcaattattgtctatttatttggatccaaacataattatcaccaaatatttcattttttccattgtttaaccccttaaagttctatctaaaatgaattacgtgattggacttaataaatttttgctgatgataattatctctctgtctgtactcctggagataaactccaggagtttactccacaggagtaatgttaatagatcccatctacatgtaagacctgtctagacatggagacgagtagggggtttgaaggcatcactttatgcgagagtaacaataagaggagccatccacgcactgtatcattgaaataaagtttaacaaaatcacaagatgttgtgggaagtcagggaccctgaacggagggactggctgaagccatggcagaagaacataaattgtgaagatttcatggacatttattagttccccaaattaatacttttataatttcttatgcctgtctttactgcagtctctgaacataaattgtgaagatttcatggacatttatcacttccccaatcaatactcttacaatttcctgtgcctgattactttaatctcttaatcccgtcatcttcataagctgcggatgtatgtcccctcaggaacctgtgatgattgcgttaactgcacaaattgttcataaagcatgtgtgtttgaacaatgtgaaatctgggcaccttgaaaaaagaacaggataacagcgatgttcagggaacaagggagataactattaggtctgactgcctgggagccggggcaggacagagtcatatttctcttattgctgaaaatgggtaagagaaatatcgctgaattctttccccagtaaggaatattaataattaacagccctgggaaaagaatgcattcccagggggtggcctctaaaatggccactctgggagtgtctgccttatgcagtggtagatagggatgaaacacgccctggtctcctgcagcacctccaggcttgctaggattaggaaattccagcctggcgaattctagtcagactggttctctgctcttgaaccctgtttcctgttaagatgtttatcaatgacagtgtgtgcacagtgggacatgaaacttcatcagtagttctagtttcgccctggccttgtgacctcgccctgcccatttgccttgtgatattttattgcctttgaagcatgtgatctctgtgacccacaccctatttgtacactccctcccctttgaaaatcgctaataaaaacttgctggttttggggctcagggggcatcacggaacctgccgacatgtgacgtctcccccggacacccagctttaaaatttctctcttttgtactctttccctttatttctcagaccagccaacacttagggaaaataggaaagaacctaccttgaaatattgggggctggttcccctgataacaaggaaaagttgaaagaaactgagtggagttttattctttttatcttttagttttttaaatttaaatgaaattgtatatatttaaaatgtacagtgtgatattttgatatacatatacatggtgaactcattactacagtacagttaatgtgaattaacattcgtggttgtattttttttcttgtgttgagaatacttgggacatgcaatcttagcaattttttttctaaagaagacatatatatatggccaataggtataagaaacagtgccaggcacagtggctcacacctacaattccagcactttgggagaccaaagtgagagaatcacttgagcccaggagttcaagaccagcctgggcaacatggtgagactctgtctctacaaaaattagaaaactagtcaggcatggtggcacatgcctatagtctcagatactcaggaagttacggcaagaggatcccttgagcccaggaattcaaggtggcagtgagctgttattgcaccactgcactccagcctgagtgacagcaagactcagtctcaaataaaaaggaaaaaagtgctcaacaccactttgcattaggaaaatgcaaatgaaaaccaccatgagatataatcataccccagttagaatggctagtatagaaagatgaaagataacaagcgttggtgaggatgagaagaaaaggaaaccctgtgcactattagtgttaatgtaaattagtacagtcattatgaaaaaatatgaagttttctcaaaaagctaaaaatggaactaccaagtagatattttcactttgaagtttatcagagaaaaatacaacattgatgaaactggaaataattaggttaagtgaaataagccaggcacagaaagataaacatcgcatgttctcacatatttgtgagatgtaaaaatcaaaacaactgaactcatgagcatagagagtagagggatggttaccagaggctgggaagggtaatgagggctgtgggagaaagtggggatggttaatgggtacaaaaaaaaattgaaagaatgaataagacctagtatttgatagtacaacagggtgactaaaattaataataacttaattgtacattttaaaataattcagagagtataattggattgtttgtaaatcgaaggataaatcctagagatggatactccattctccatgttttgcttatttcacattgcatttatgtacccacaagaattaaaaaatcaaaaattaaaaaattaaaaaagaaaaatacaatgtgtttattatatcttttaaaaaattggtgttttgtttttgtaaaagaaaatacagtaattatttggttgattgcttcataacatatgtaaactaacagccaactagcaagataacttgaaatattaattttttggcccatttttattcctgctcttccagatgtatgaacttctctcctacttagaaaaaataaattgcataaaaaattaagatttccataatttattagtttttactttccaaaatataccttgattagacacaacagtttcggaagccaaaattttctttttttatataggtttgtttagatcaaaggtatttgacaatcaaaagcctgtacatgaaaaattttgagtttattccatttcaaagaattggggaagagaatcaatagacacgtagactaggtaatctttaggaaagactggaggagagtacctgggctgaggaagacaggagtagttgatgcagcaagggtaagtaggactatagaaactgacaaggaaggaatcgcatctaatggaggaggagtgggataggagattcagtacaaagagactgttgaacactcttgcttagactattaagcactcttgtttatagcaccagaaagttggataaatgggagttggtgcctacagagtgctctggtctgaatgcgtcccctaacattcacagtgtcgaaacttaactaccaatgtgatagtattaagaaagtaaggccattaggatgtgattaagtcaggagtgaagagccctcatgaatgggattagtaaactcataaaagagactgaagggagtgacctagtccttttttgccctttttttcttctttgaccatatgaggatatagtgtccaccctcattggaggatacagcaacaagatgccaacttgaaagtagagagtgagcccttaacagacaccaaatcttctggcaccttgatcttgtaccagctttgaatatacttttaagtaattattgagaagtaaatttttattatttttgaattattttatctgtggtattttcttatagcagcagaaacagactaacacagagataatatgttatcacaggcctttgagtgaggcttgcctatgatgagtagctgctgtcattgtttttgtcactgttgagaggcaatcatgacagctctctgaatccccaaaagattttccagattaaatcagaactacctgtgattgacttgttcagtccactttatctgcttataatgacaaatctctttcagtaatatatggtcttgaggctcctaaaacagagggcaggatcttgaatatccagactacacatgttggtggtggttataactgtttagaagggaaaccacttctaaacttcttagtcccaatacttgtatgagtccaaagcagtggtcacaatttgctaccacaccaattccattagctgtttttgtgttatgttataaggtgaacaattcatattgtaaatgggaagtataatggtgagaatagactctcatctgtgacaaattgttttcaggtggagtcatgagtcttgaaagatgagtaaaaaaaattccaggcttgggccaggatattggtgtgagtgtatatatctagcaataaaaaattgttttaaacatgaaaatactgaacaatataagtcattatagatgaatttgaaggatcaatgatgagataaggctggagaattaggaaatttctatatcatcaaggaattcttttcacttgaaatctattagattttatcctctaggccaagggtccccagtccctgggctgcggaccagtagcagttcatggcctgttaggaactgggccatacaacaggaggtgagcagtaggtaagctagcattaccgcctacactctgcctcctgtcagatcagcagcggcattcgattttcaaaggagtgcgaaccttattgtgaactgcatttgtgagggatctagattctgtgccccttaagagaatgtaactaattcctgatgatctgaggtggaacagtttcatcctgaaacaatcccccacctcccgtcccacggaaaaagtgtcttccacgaaaccagttcctggttccaaaaagggtggggatgactgctctaggccaaagagatttttaaatctccattgaggaatttcaaagagatgaaggaaatgataagatttgcattttagaaagattactctgtgccgtgatcaaggatgttcagactgaaaagagacctttgaaatgctatagaccttgagtcttgcttgaagtgtaattagaactaagatacatggttcttttgaatatagttgtaagtaattattaagaaacttctgctattgctatttttattttatttatgctttgtgtgtgtgtgtgtgtgtgtgtgtgtgtgtgtgtgtgtgtgtgtgtgtggcagggtctcgccctgtcacccaagtgggagtgcagtggcatgatcatggctcactgcagcctccacttcctgggctcaagtgatcctcccacctcattttttgatttttttttgtagagacgaagtctcaatatgttgcccaagctggttttgaactcttaggctcaagcaatcctcctgcctctgcctcccaaagtactgggattataggcttgagccactgcacccagctgttgctatttttaatatttcataataatttatcttctacattttgtttttatgagcatgtattttttattacaggtctgttgtcctttatttcatgtggactataaagccctattttatatctagtatactgagtcacggtggtggcaggcagaaggagagaaagacaatatttattgaccattttctgtttaatatgtactctgctaggttcttttaatttatagctacctaaatgatattcagtgagaagtagttaaacagaaataaaagtttagctgctatatctagggatagagttactgcttttttagcaaatatgtgatggtgtttgtttttcagcctgaagggactatatgtttgattttcaaccacaataaagaaatagcctttcttattaaataattgttaaagttatttcagatggcacaacatgtgaagaatgtgttttgttgtagtgagtaagtaaatataacacacgtacataagccaccaagttattaaaatagaaaagcatttatagaggcacacaaaacgaaaagtcacatcaagaataatcccttgttaacaaagggcagaatagaccagaacaagaatattcttgaagtagattcatcaacagaagaaaaaggaataaagactatcataaaagaatcgctacttgtagtaatattaggtcaaggattttccattgctctttagtgaggggtaatggcaaagttagataaaaccttcactgtaaggtgttcactcttgccatttgtaaggctagattatgctattaatctttgatgaaggttctgctagtcccaacaaatacctttttttctttataaatctcctacttaagcatgccatccaaatattgtttgaaatagataactggattggatgatcctttattaacttttaatcaagattttgattcccagaatgaagcatggtgaaccatatccctcacagacttttgtttttacttaataaagctaattattacatattctacttgattcacataaccagtctataagattttattcacattttacagaaaaattgaagttcagaaggaattatgcatcttaatcaagaccacatatccagtaagaagtagatacaagaaacaaacataaaattgggtaattttgttttattttcagttgccatgcctttttaatattttttaaactggaacagtttctggatcctttattgtatttcttgacattgatgtttttgaattgcacagaccaattgttttgtagactgtcttagtccacttgagcttctgtaagaaactgccatagactgggtggtttatgaaaaacagaaatttatttctcacagtcctggatgctggaaagttccataatctaggcaccgacagatttggtgtctggtgaaagctagctttctggttcataaagggctgttttctcactgtgtccttacttggtggaaagggaaagagagtcttttgggatctcttttgtaagtacactaccctcatgatctagttaatgacttatcaaaggccccacctccaaatatcatcacatttgggatcaggacatacatttagcctatagcatagactatccaacttgagttttttttaaatatttttttcaaattttttatttatgtttccataggatgagattcaggtcatacaattgtggcaggaataccacaggagttatgctaagttattgtatccagaggtacatgcattactgataatcttatctttgatcatcttggtaaaatgttgtcttccaggttactccactataaagttactatttttcccccttagtaattaaaaagtatttgtaaggtgataatttgagaccatgtaaatacattgttatttcttaagtttttacctaagagatttagaatccattgatgattcctgcctgaattatttattaccatgatgattgctgtcatagcccattgtatgcagctatgccagaataccacagactgggtaatttacaacaagcagaaatctatttggctcatgtgttctagaggctggaagtccaaggttgaggggccacttttttcctgtgttatcccatggtgaaaggtatcaagtgggtgagggagagggaaggggaccaagcccatttttttgtaagcaacctacttcccggtaaatggtaataatccattcacaagagcagagccctcatgacctaattctcttaaaggttcaatctggcaacactgttgcacaggggattaagtttccaacatatgaaatttagagatgcattcaaactttggcagttgctaaggggtactttttaattctatcatttcttcttatcagttggctttctactatgtgtaaggatattccaacttgttgtttgtttctgtgtagactgatggattatttaataggttataatgttttaatattgttagttcatattattatttattttgatgttcttattgtcccagatttggacaaaatatgctgtttttaatatgttctttgttattttaacatgtcagtatcattagttgagtacttttttactttttggcaaaaagatattttagattcttgtaattgtccctcctccagccttggtatcagctaccctttttaaatacccccagttccttttagtagaaaatgcctttacaaactaagatttgaggagtaggtatgctgattgttattggggagatgttgcttctagtctttcagcagaaacatctagggaaaaagtatatgtgtatacatacatatataaacatatacatacataaaaatacccacacatatctgtatttttgtgtatgtttaggtgtatgtagatatgaagcctatgattataattagaatcaaaatcatcattgtgaaattaaatttaggtctgaactttcttgaagaaataacagataaagaaacctgagaatatttatgttttcaggatagaaattttttcctgtaattaattctaagacttcttattatgatctttgtacaaagcaaaccgctaatgtttttaacagtagttttatgtgagttgcataaatgtacataattaatcatagataccttcaaatgttcttatatttactcttgatacaaatcaaactattaaaccattattccatttaagtattattatagaaatttaaatcattacaggtcttgtgacttgatattgaaaaagagcttagtacacatagttcaatgactttttagtcttgctatttgattatctttctcatatattacttgtctcaatttaacttggcagaagcttgattacagaaatgaaatggtggtcaattcaatatttggttcttttaaaaacctgggaattgacaatttataattgtatacattttgggggcacaaaatgatgttaaaatttatgaacacagtatggaataatgaaatcatgctagctaacatactcgttacctcaaatacttaaattttattgttgtaagaacatgtgaaatttactttctcagcaatgttgaaaattaactatattctccatactgtattattaactatattctccatactgtgcaataaatctcaaaaagaaccctatatccttcctgttctactaagattcaatgtcctttggatatcatcttcctattcccctcaaccccagcttctgtaaaccattcaattctctgcctctgtcagttttattgttttagattccatacatgcagtatttttttatttctgtgcctggcttatttcacttaacctattgttctccaattccttccatgctgttacaaatgacaattttgtttttaatgtttaaggctgaatggtattacattgtgtatttatactaaattttctttattcatctgctgatgaacaattaagttgattctataacatagctattgtgaataatgctgtaatgaacatggtagtgtagatgtctctttgacaaattgtttttaaatatttttgagtaattacccagaactggggctggtggattatatggtaattgtatttctaactttttaagaaactattatagttttccataatgactttactaaattacattcccaccaatggtgtacaagggttcccttttctgcatatcctcgccaacatttattatcattcatgttttttataatatacattctcacaggcatgagatgatatctgtattagtctgttttcatgctgctgataaagacacacctgagactgggcaatttacaaaagaaagaggtttaactggacttacagttccacatggctaaggaagactcacaatcatggaggaagaaaaggaagagcaagtcagcagcttacatgtatggcagcaggcaaagagagagagggagcttaatgcaggggagttccatttttaaaaaacatcagatcttgtgagacatattcactatcatgagaacagaacaggaaagacctgtccccataatttaatcatcttccaccaggtctctcccaccacacatgggaattatgggagctacaagatgagatttggatggggacgcagagtcaaaccatattattccacccctggcacctcccaaatctcatatcttcacatttcaaaaccactcatgccttcccaacagtcccccaaagtctcagcttatatcagcattaactaaaaagtccaaagtctcatctgagacaaggcaagtcccttccacctatgagcctgtaaaatcaaaaggaagttagttaattcctagattcaatggaggtacaggcattgagtaaatacagccattccaaatgggataaattggccaaaacaaaggggctacaagcctaagcaagttcaaaatccagtggggcagtcaaatcttaaagctcaaaagtaatctggtttgactcgctgcctcacatccacgtcacactgttgcaagaggtaggttcctatagtctttggaagctccgcatttgtgactttgcaggatacagcctccctcctggctgccttcatgggctggcattcagtgtctatggctttttcaggagcacaatgcaagctgtcggtggatctacaattctgggatctggaggatggtggccctcttctcacagctccactaggtggtgccccagtagggactctgtgtgggggctccaaccccacaattcccttcgccattgccctagcagaggttcttcatgagggcctacccctgcagcaagcttctgcctggacatccaggcatttggatacttcttctcaaatctagatggagcttcccaagcctcagttcttgacttctgttcacttgtaggctcaacaccatggggaagctgccaaggcttgggacttgaaccctctgaagccatggccagagctctatgttggcccctttcagccacaggtggagtggctggggcacagggcaccaagtccctaggctgcacacaaaagggggaccctgggccaggcccatgaaaccactttttttcctaggccttcaggcctgtgatgggaggagctgctctgaagacctctgacataccctggagacattttgcctattgttttggggtttaacattcagctcctggttacttatgcaaatttctgcagccagcttgaattactcctcagaaaatgggtttttcttttctatcaaattgtcaggctgcatattttccaaacttttatgctctgtttcccttataaaactgaatgcctttgacagcaaccaagtcacctcttgaatgctttgctgcttagaactgtcttctgctagataccctaaatcacctctcttaagttcaaagttccacaaatctctagggcagggataaaatgccaccagtctctttgctaaaacataacaagagtcaactgtgttccagttcccaacaagttcctcatctctatctgagaccacttcaacctggatcttattgtccatattgctatcaagcttttggtcgaagccattcaacaagtctctagaaagttccaaactttcccacattttcctgccttcttctgagccctccaaactgttccaacgtctgtctgttacccagttccaaagtcgcttccacattttcaggtatcttttcagcaacaccccactctactaataccaatttactgtgttagtccattttcatgctgctgataaagacacacctgagacccggcaatttacaaaaaaaaaaaaaaaaaaaacagatttaattggatgtacagttccacatggctggggaaacctcacaatcatggtggaagacaaggaggagcaagtcacattttacatggatggcaacaggcaaagacagacaaagagcttatacaggggaactcctctttttaaagctatcagatctcgtgagacttattcaccatcacaagaacagcataggaaagacccaccactgtaattcaatcatctcccaccagttccttcccacagcacatcgaaattatgggagctacaagatgagatttggaaggggacacaaagccaaaccatatcaatatcccattgtgttttaaatttgcatttccttaatgattagtgatgctgatcatttttcatgtctgttggccatttgtatatcttcatttgagaaatgttgatatgtacctgtattagtctgttctcacactgctaaaaataaatacccaagactgggtaatttataaagaaaagtggtttaattaactcacagttctgcatggctagggacacctcagggctcttacaatcatggagaaaggcacctcttcacagggcagcaggagaaagattgattgccagcagggtaaatgccagatgcttataaaaccatcagatctcatgagaacttcctcactatcatgagaacaacgtggggaaccatgcccatggttcagttacttctacctggtcctgcccttgacacatggggattatggaactacaattcaagatgagatttgggtggggacacagccaagccatatcagtaccccttgcccacttttaagtgagtttcagttttcttgctattgagttgtttgagctccttatatattttttatattaccccattatcatatgtatggcttgcaaatattctctcccaattaatagattttcttggcatagtgttgattgtttcctctgctgtgcagagctttttagtattatgtaatcccagttgcctatgtttttgtggcctgtgcttttagagtcgaatcaaaacaaaaaaaattattgcccagatcaatgtagtatcattttactcctgtgttttttttaatacttttagagtttctggtcttttatttaagtctttaataaaactggctatttaaaatcacatatcttttttgccaaatgaattttatctgtatatgcatcatatctgtgaatgtcctattaaatttctcactgaattacaagtggtattggtgtgtcaatggaataactaaggataaaagaaaatgttattttatttacccattcaacaaatatgtatttaatggctattgtatgccaagttcagtctaagagattgttctggagataatggctgttgtattctgtgtaaggtagttggtatttgtcaagaagagtgttggagaacattaaatgtagagtcctttgtatgagaatgagatgtagtgcttgaagagatgtcagaatacactgggttcctagaaattacaatgaacagatcttgatggaataaccagatttaaccttttgcacattttcattaatggatacattctctttgagagaggttaatatagaggtgcttgaaagtaaggatttgaaatgtcaacattttccagttatctcttagtatacagtgatgtattcttaatctttctaaatgctttttttggaccaaatgaattaccaagtaaatcaagaaacaatctttcgatacctaacaaaactgacatcatgaaagaaactagatttttttcagctaatgaaatagcgtacataaaatttaccataatttttacattttttcaacatttaaaaataataaggcattctaggtttttaaaccatttacaacaaattttttttttcaatcacaaagaaaaatctaaaatattcttatagtaaatccactgatatagtttggatatttgtccccacccaaatctcatgttgaactataatccccaatgttggaggtggggcctggtaagaggagtttgggtcacaacggtggatccttcatggcttggtgttatcttcaccaaagtgagtgaattcttaggagatgtggttgtttaaaagtttgtggcatctcccaccacctcttgcttttgcttacactatgtgacatgcttgcttccactttgcctttcaccatgagtaaaaagctccttgaagctttccaagaagccaagcagataccggtgccatgcttgtacagctcacgaaactgtgagccaattaaacctctttttttaataaattacccagtctcagatattcctttatagcaatgcgggaagagcctaagatacctacataccttccatctagattctataattataattttttctacattctttaccatatatatatctatacttccatcaatttgtcagtttatcttatttttacattacagttccaaagaagttacatacatcagtaaatcttacacctaaactcttcaatatgcatattatttacttgacatccatatttatgttatttttcttacaatatgaatgaggtataatttatatgcaataaactacacacattcaagtcacacaattttacaagttttgacataagtatgtatacatgtaggaatccaacacttcaatcaacatacggaaaatttgtttcacccacaaaaaaatttctcagatctttttgaaatccctccctctctctaatccctacataaccactgatctgttttttcaacagcatgtattattgttcactttttaaaattttatatggatgaaataatacagtatctgactacttttgctcagcataatgcttttgagattcatccacattgttattttatcaacttatttttcctttttattgctgagtagtatttcattgtactcaaaaatgttgctgggaaaactggatatcattatgcagaagaatgaaactagacccctgtctctcaacatatacaaaaatcaaatcaaaattatttctctctatattcatactacagtttatttaccatgctcttgttgatgagcaaactggactgtttgaagtttggtcaataataaaactgaattttacattttaaaataacttaaagactttaattggattgtttgtaactgaaaggataaatgcttgaggggatagatacctcattttccatgatgtgcttatttcacattgcatgcctgtattaaaccatgtcatgtacctcatgttggaggctcaaatgaataaatctactgttcttgtattgccattcttgtactagacttttgtattcatgtttcatttccttggatgaatgaaattgggaaatagtgtgtaaaatataatagttaaaatacaatattgatcttataaaaacaaaaaaaaattatctatcatatgttaatagtgtttttttacaggaacctctgtcacaccctatgccttagggattattcaaatgttaaacaaatgtatcataaacaatagccttttaatttttcagtcactacaattctttggatgaagttacatgtgaacacaattgttttatcatgaattttacttagtatatattggtgtcagtatagttaacagacttattttctaatagtctagtgaccatcaagcttttaaaatttgaatctagacgagattgtcataattctgtaattttttccttcacattatggagtaacaaattgttaattgctttagtggtgagaactgaaaagcaatgaacaagtttaatggtacatttctcttttttgtccctcaaaatcaccaagtatgagatgattttcagaatgtctagattttggaattatcatcattgttgattatttggttttgccaatacatttattaaccttttcagaaaacaatgtcaatgtttttggtaaaacattggattgattataaagaccctcataaacacacatacacatacacatacatgcacacacacagacatgcacagaagcatccatgcacatacagagacagatagcattgtagttagctaagattaccgccttttatagcattgaggcagccacagatagcagaagtaaagtattacttttttgcaattgcccttggttcctaaaatctctaaagaaggcatttgattgtgtgacataatgcccaccgaggcttatgccctacttcactggagtagctattttttgttgtatcattcagaaatgaagaaaatagccatgatctgaaatattaagagactttcaggaactggaacgtttctgttctccagccaaacttagcatcagctaggctacattccctaggaagaaggaagacaacaaaatatccagatgcacagtgatattgtccaactaaatgtcaggtgatattgtccagaaatcctcaaataatatatctccataattccagtattcctgagaaccaagttatctccccaaatatttgataataaaataatttaatagcatgcttcctcattgaatcttagggtgacatcaaaatactaaaataacgttattttgtaagagcagaaatatcttgatttagatctcagaactaatatttgcactatgcactacactcagtgaagaaaggcactaaatcaaataacaaaaatcacattaagaaacttgagaattatttcatatataaaagcctcattcatagctcccacttcgaacaattaggtaagtgaaagtactaaggtttgaatattatctccctttccattgtatattgtggcagttttaaaaagcaaatccacagtgttgtcattcctctcctcaagagagggagcttaattcccctctttttgagggtggactcacttagtaactgttctaaattttagaagtgtttgcgtgtcacttctgaatttaacttattaaaaaaacacagcttgcatcttgggttcattctctctctctctccctctctctctctctcatcacttgccctggaaagcagactgccatttataatgagccctacggagaggccatgtggcaagaagctgaggctgccagagggaacctgaggcctgccagcaaccacatacatgagtttggaagttaattcttcagcttcctttgagtcttgaggtagctacagcctggccagaacttgactaaacttcataagggacactgagccagaaacacctaactaagcaaattctggttttatgaccttcagaaattgtgtgaaataataaatatttgttgttttcattattcaccatagcaaagtcatggaatcaacctaggtgcccatcaacagtggattggataaaaaaggtgcacatataacgcatggaatactatgcaaccataaaaaagaatgaaaccacatcctttgcagcaacatagttacagctatagagcataatcctaagcaaattaacacaggaacagaaaagcaaatattgcctgttctcacttataagtgggagctaaacattgggtatacatggacataaagatggaaacaatagatgatgaggactccgaaatggggaaagaactggagtaacggttgaaaacctacctgttgggtactatgttcactatttgggtaacagattcagtagaagcccaaaccctagcattatgcaatgcacccatgtaacaaacctgcacatgtacccactgaatctaaaataaactgtatttgttgttgtaagatgctaaagtttgggataagttgttctgcaacaataggagtgtgtgtgtgtgtgtgtgtgtgtgtgtgtgtgtgtgtagagagagagagagagatacagaaagacagaagaaaagaatatttttggcaagtaaaacttgcatattaatgaaaagaaaggatatttttgataaagtaaattctaaaatacaatatataaactaatacatatatctgtttggatttaatagatcagagaccattgtaaaaacagtgtgcctattgcataaatatccctaataaaaaactcacaattctgtaataaaattattatatattttaattttgaaagatgtttcaaggctgaactatccagatgaaagaggtgaaatccacataattatgcttgaaagcatatggttttaatttttatatttttgtaattaagtgaagaaattaaggggcattgaagatttcacctctaagcagctcacagttttcctaagcttggactaggtgacaactctctcaatctcactcaaaacatattttagtataaattaaggttaatctgtgaatagatgtcaataacattttcctattaaataaatacaaataccttgactttaagatacaaaaaaactacttgtcatttagtattttgtatttttaacttgccagatttatgtcataatataaatgccagaattttgtctaggtgaaataagaatcatctgaaacacattcattattatttcatcagaataagcttgaattatgtttttgtatatttcagtaaaattatgatgagaaaacaaactataaaggccaaaatatttctattgcttactcattaaaatgtttttaaagattcaacatttacatattgtttctctgctttctcagttctaccttataaagcctataactctcattaccacagtacttactctcccaacaatctactaaaagacagacaaaagcccaggtatatcactgtacttgaatttgtatttttattctgaataaaaacaattgactgatactctttatgtggaaaaaccatacatttgatggacaataattttccaaaacagactttttgatctatcatgacattaaaagttcaacacatttccattaaggtctagaggccctggtaaaaagcacattaattacatttgctgatgacaataaatttaagcatggatccaatactactaactccaaagaattatacagacctagcaacttaacaacaaggaacattttggcagtatttttagctgtatattatatttttcttctttgaaagagtacagtataattttacttgactgaaagacacaacgattaacttcatcaagtgtgtggaaattcatgaatttgaggaaatctctctctttagaatttttttttcactttcttttcatcctttcatggatcatttttttaatgcttcttttaccctataggtggcttttaattactttccctattaccactagcagtgcaggaatcttaccgaaaatatttgtggctctgtctcagggtatgagaaaatatttgcaaattagactcacattctttaatgaccctcccattaccttcttattgaattataaattggctctgattctttactttgatgcctcacatgatcattcttcctgaatttccattgcagttttgttccttactgtctgttgttgttttgctcatttattcattcattcattcatgatctattattattttcattctatcgacatctatttattgattctcataatgtatcagatacagtataagtcaagaagacaaacatcgatgaatagggcacaatcattatctttcatggcactttagcaaccattaatcattattacaaacctaatactttaatgtccattatactttgtgctataaaggaaaacaatagaactaagattataatgttgtggaaattatcaaatctaaaagggcagaaaaatcttcagcataaaatccatatttaggcaaagccaattgtaagtaatacaaatttgccacaagtaagaagtaaaaaaaaggggagaaatctaggcatacaaaataacacatgagaaaactctggaaggaacaaacttgttggaaatgctacaaattggtaatgtgtctagatcacagcaagtaaaggagaaaatagagatgaaggtgaagagttgggcaataattggattgtgcaatgctttgtaggacattatagattttggattttattctaagtacaggtaatttgtgtaaggctagagcagcgccaaatgatctagctggtaattcttagataattacatgtctttcattgtctgctttaaagttgtgatcttaggaacttctagtggctaggcataaaactagctaagtatttcttagaatccaagcttgagttggtgccttggtactcatttcttagagaacagagggcagatatttattttaaaagctttaagcgacattgcataatgtaaggttaatataaacatttcagtgctttttaaagctaccatttataatagcatacataaatattgtgaatacagtggggttgttttgaggcaggtctcataacaatgtcaagtatgaataagttttttcaaaaatgtgttagacaagtatggaaaactattaaggattaaacaatgtaattttttaaggatatcatgttcatggtttggaaggaccaatattgtaaaaatgtcaaatttttttttttataatttcatgtatactttccatgaaatcctaattaaatttacaaagaccctttttagtgaaaactgaaaagctaattcttcactttatatgaaaattcgagtgatgaagcctaacaaaaaacaatgtaggtgaaaaatgaaatcggaaggattaattccacaggatcccaagacttattgtaaaacctcagcaattgatacagtgtgttcttggttcaaggacaaaaaatacaccagtggaatagtatagagaggcaggaaacttttggacacttgctatatgacagtggtttatgcagagcatgaggagagtgatatatgtcttttctgtttgtttttaaaataaatgacagtggcttacttgaaagcctatatacaaaacgtaataaacctcatacctacatcacaccattcacaaaaatcaatattaggtgaagtgtcgatctaaatgtgaagggcaaacaagttttctaggtgaaaaatattcaaaggtatctattatttgggagtaggaaagatttttttatatatgacacaaaatgtatgaataatttaaactatattaaaattaaaaatttctagtattccgaataatatgaaaaagtaagtcacacggtggacaaagatatttgcaacacacattaaaataagggacttgtatttaaaatatgtgaagattcttgcaagtcagttaaaaagtcatatagcactgtgtaaaaatggtcaagagacttgaacaggtacttcacaaaccagggaattcaactggacaataaacatgaaaagatgctccatgtcattgttcatcagggcaattaatatttaaaacagtcattcttttttagtttaagtatcctggtggaagactagcataaaagagtccacattctgtcccttgaagattcatgtagagcacatctacaaaatagatttatgtcatcctaagttcctcaaaagtctcattattacagcatcaactcaaagtccaaaatttcattgaaatctcatcagctcaatagtcccacgtctcataatttaatttatgtaaatcacctatgggtgaggctctaggagtaatctgacttgggaaacaatccttctccatccctggacttgcataattaaagaatcatgttaccttatcccaaaatgcaatgacagaaaaagcataagtaatagttacagacattctgctttaaaaccagagaaaacaaaagagaaaggattcccaaaatttaaaatgtatctaggcaaactccatcagctttcaaggccttgtaattatcctatgtgttttttgcctctgaccttggggctcaaagctccactctctggacttgtcattgatctttcctagaaaatctcaaatttatatttaacttttgctgaggtggctgagggacagtattcttgagcttcctagatactgtctactttgattggacagttctgtgagtcacacccagaatctcataaaagggccttttgtgtaaaaatactgtgactttggggagtgatgtcaccaaaattgcagagtagatacaatctggcttcactgtacttcaaagaaaaccaaaatgatcttcaacactaagatcatccctagcagtattccagagctcaaatatgaggatgagaggatttctgggccatagaaaatggaaaaactccaaccagatgaaaagagaaaaggaattctccatccttgaggcccctctcccaatctgccagcattgcatattgatcattgctttaggactcacaatttcttttttttttttttttaacttttgcttttttaaatttttggttgaggttcagggatacatgtgcaggtttgttatatagttaaattgcatattatggaggtttcatgtacagattatttcatcacccaggtaataagtgtcggataccacaggcagttttttgatcaccttcctcctcctacctctatcctcaagtaggccctggtgactgttgttcccttctttgtgtctatttgttctcaatgtttagctcccacttttaggtgagaacatgttgtatttggttgtttgttcctgtgttagttcaattaggaaaatggcctccagcttcatccatgttgctgcaaaggaaatgatctcattcttttttatggctctgtggtattgcatggtgtatatgtaccatattttcttcatctagtcttctgtggatgggaatttaggttgattctatgtctttgttattgtgaatactgctgtgataaacctacgtgtacaaatgtctttatggtagaaggatttatattcctttgggtatatactcaataatggaattgctggatcgaatggtaattcaacctgtaggggaaaaatcccctgaagacaactggagacagagaggaaccaggaatggaaacccaagtttttgaaactctgctctttatctcagctaaaggaggattcaaatcagaatggctattcagcagcaccgtgctgtagcagccacactccatgggtcttctgggcatgaatgcatagccagtcttcccacacatattccttctggtatccccccacctaccaatctcagacaggtggtgctttaacatttgtgagagtagaggcaaacctgggtttatggtgccatttaggaggtagcggcttaggattatggagaatcagaggcaattacaaagaacctgtaagcaaacataccctagaaagactaaaacaagcaagacagtgaagactggaaaaaatttaactaatacttcattgtgaaaccatcgacatatattcacaagaaacaacaggaagcaagggaaccatgaactccccaaacagacaaaaacagtaagaccaaccctaatgagatagatagtgatgtgcaaggtcttagatcaaaaattcaaaatagcagttctaaagaaaccaagcaaactaaaagataacaaaaaagtaattcagaaatgtattagagaaattcaacaaagagattgaaataataatttaataaatccagcagaaatcttggaactgagaaatatatctgctgaactaaaaatgcattagagtctctcaaaagaggaatggatgaagcagaagaaaaaaatcagtaagctcaaagacaagctatgtgaaaacagaaatgaaaaaggagacataacaactgataccacagaaatacaaagaatctttagcaactttatgaacaaccatatgccaagaaattggaaaacctagaaggagtgaatgaattcctagacacatgcaacatatcaagattgaaccatgaagaaataaaaaacctgaacagagcagtaacaagtatcaacatcaaagcagtaatcaaatgtctcccaacaaaggaaaacccaggacctgacagtttcacaggtgaattctaccaactatttaatgaagtgctaataccaattctactaaattttccaaaaaattgaagaggtgtgaatacttccaagctcattttataaggccaacattactcttgataccagaatcagacatggatccaacaacaaaaacatgaaactacaggacaatattcctgatgaacataaatggaaaaatccttaacaaaataacaaatttaaaagattacttaccatgatgaagtggtattcattctagggatgcaaagttggctgcacatacacaaataaataaagagatacatcacgtcaacagaataaagtgtaaaaaccatccagtcattttaataggtgctgaaaaaacattcaacaaaattcaacatcactttatgataaaaacgctcaacaaactcaatatatacctcaaaacaatgaagaccatatgtgagccgggtgtggtggctcagacctgtaatctcagcactttgggaggcagaggtgggtggatcactcgagcccaggagtttgagaccagcctggggaggatcacctgtacctgggagatcgtggctgcagtgagccacaattatgccactgcactctaatctgagtgactgggtaagatgctgtctcaaataaataaataaataaataaataaataaataaataaataaataaataaaaagaccatatatgacagtgtcacagataacatcatactgaatgggagaaaattaaataccttttctccaagatctaaaacaagacatggatgcccactttcattagtttttttcaacatagtactagacatcctgaccagagcaattaggcaagagaaaaaaaaaagggaatccaaattgggaaggaagaagtcaaattgatcttgttcacaggtaaaatgatattatatttacaacaacctaaagacatcaacaaaaaacttttagaattgaaaagtgaatttagtaacattgcaggatacagaaccaatatacaaaaattgtcatttatagatgccaacagcaaatgaatgaaaaaactcaacgaactaatccaatttataacagacacaatatataaaatatctaggaattaatttaaccgaagaagtgaaagtgctatacaaggaaaactataaaacactgattaaaaaattaaatggggcacacaaaaaagggaaatgctcatggactggaagaattaatatttttaaaaggtcagtgatctacagatttagggcaattatgcaattattataaaaataccaatgatattccttatagaaatagaaaaaaatcataaaattaatatagaaccacgagtctccaaatagccaaaatcatcctgagccaaaagaataaagctggagttatcacactacttgatttcaaaatataccacaaagccatagcaataaaaacagcacagtactataatataaagagaacatggatcaatagaccagaaaagagaacccagaaataaatgcgtagatttacagccaattcttttttttttttttttttttgggatggagtttcacccttgttgcccaggctggagtgcaatggccagatctcggctcactgcaaactccgccaccctggttcaagccattatcctgcctcagcctcccaagtagctgggattacaggcatgcaccaccacaccctgctaattttgtatttttagtagagacagggtttctccatgttggtcaggctggtctcaaactcccaacctcaggtgatctgcccacctcggcctcccaaagtgctgggattacaggtgtgagccactatgcctggcccagccaattcatttttaaccaaattgccaagagcatacattgtgaaaaggtaatatcttcactaaattgtgctgggaaaactggataaacatgcagaagaatgaagttagggcattatttctcatcatatacaaaaccaaatcaaattggatgaaaaacttaaattgaagaccaaaaactgtgaaactactaaaagtaaaccttcaggaagcactttgggatactgatctgagcaaagatttttgagcaagacctgaaaagcacaggcaacaaaaacaaaagaagacaaatgggattatatcatgctgaaaagtttctgcaaagcaaaggacacaatcaacaaagtaaagagacaacctacagaatggtagaaaaaacattgcaaactactcatctgacaaggggctaataaccagaatatatgaggactgcaaacaactcaatagcaaaaacaattaaataaatttgcttaaacaatgggcaaataatttgaatagacatttctcaaaagaagaatgcaaagggccaataggtatgtggaaaatgctcagtgtcactaatcatcatcagagaagtataaattaaaccacaatgagatattacattgcttctgttcaaatggcttttatcaaaaagataaaaaagtaacggaggctggtgaagatgtagagaaagggaaatacttgtacactcttagtgtgattgtgaattagtacaatcactatgaaaaaaagtattgaagttcctcaaaaaatctaaaaatatattcagccacaataaagaataaaatcctgacatttacagcattgtggatgaacctggaggtcattatgttaagtgaaataagccatgcacaggaaagcaaatactgcatgttcccactcatatgtgggagctacaaaagtgggtcttacggagatagggagtagaataatagttaacagtgactgaggggggtgtgtgaaaaggcgatgaaaagaaattggttaatgggtatcaagtgaagttagaaggaatatgatcttgagtttgatagtacagtagtttaaccatagttaacaataatttattgtgcagttcaaagtagctaacagagaaaaactggaatgttcccaacataaagaaaaaataaatctttgaagtcatgaatattccaattattctggtttgatcattagacaatgtatgcatgtatcacatgtaccccaaatattacaactattatgtatcaataaaaagaattaatttagtatacatgagtaataacaacaaaacattgtgaccttgtattttactgatgaaggtattaacagtatgttagtctgttttcatgctgctaataaagacatacctgagactgtgtaatttttaaaggaaagaggtttaattgactcacagtttcatatggttgcagaggcctgacaatcatggcagaaggtgaaggaggaggaaagacacgttttacactgcagtaggcaagagagcctgtgcaaaagaactgctctttgtaaaatcatcagatctcacgagacttattcactgtgaaaacagtataggaaaaacccaccccatggttcaattacctcccactggggccctcccatgacatgtggggattatgggagctacagttcaagatgagatttgggtacacagctgagccatatcattctgcccctcccccctcccaaatcttgtatcctcacatttcaaaatcgattgtgccttcccaacagtcccccaaagccttaactcattccagcatgaactcaaaaatccaagtccaaagtctcatctgagacaagccccttccacctatgagcctgtaaagtcaaaagcgagttagttactttctagatacaatgggggtacagacattgggcaaatatactggttccaaatgagagaaattggtgaaaatgaagggggaggggggacacagaagtttgaaatccaatagggcagtcattaaaacttaaagttccgaaaggatcttttttgactccatgtctcacatccaggtcatgctgatgcaagaggttggctcccacagccttgggcagctccgcccctgtggctttgcagaataaagcaccctcttggctgctttcatgggctggcattgagtgtctgtggcttttccaggtgcacagtgcaggctgccggtgaatctaccattctgggttctggaagacagtggccctcttctcacagctccactaggcagtgtcccagtggggactctgtgtggggactctaaccccacatttctcttcctcgctgccctgacagagattctccatgagggccctgcccctgtagcaaaattctgcctgcacatccagacatttccatacatcctatgaaatctagccagagattcccaaacctcggttcttggcttatggtcacccacaggctgaacaccatgtgaaagctgtcaaggtgtggggcttgcaccccatgaagccatggccaaaactgtaccttggcccctttagccactgctggagcagctggaacacaggacaccaagtccctaggctgcacatagcaggggggccctggacctggcccaggaaaccacttttccctcctgggcctctgggcctgtgatgggaggggctgtcatgaaggtctctgacatgccctggagacattttccccattgtcatggtgattaacatttatctcctcgttacttatgcacatttctgcagctggcttgaatttcttcccagaaaatgggtttttcttttctgttgcatagtcaggctgcaaattttcaaaacttttatgctctgcttcatcttcagtgctttgccactttgaaatttctcctgccagataccctaaatcatctctctgaagttcaaagttccacaaatctctagggcaggggcaaaatgctgtcagtctctttgcatagcaagagtgacctttactgcaatttccaagaagttcttcatctcaatctgagaccacctcagcctggactttatttccatatcactgtcagcattttggtcaaagacattcaacgagtctctaggaagttccgaactttaccacgtttttctgtcttcttccgagccctccaaactgttccaacctctgcctgttacccagttccaaagttgcttcctcatttttgagtatctttacggcagcaccccagtctactggtaccaatttattatattagtctgttcttctactgctaataaagacatacccgagactgtgtaatttataaaagaaagaggtttaatggagtcacagttccacatgactggggagtcctcacaataatgacagaagacaaaggaagagcaaaggcacatcacacatagcagcaggcaagagagtgtgtgcagaactgctctttataaaaccatcagatctcatgagacttattcactatcacaagaacagcatgggaaaaacccacccccatggttcaattacctcccaccaggtctctcccacaatacatggggattatgggagctacaattcaagatgagatttgggtgggaacacagccaaaccatatcaagcaaaatgctgtctggtcacaccattggctttctttccagaatcaactttcctcaaagtagatctcctaatattagtgtcttttgcaatcaggacaggccaaaaagatccctagtcatcaagacctgtttcctttttgcttaacagttagttcttctctcaatttatctccttccttttgcattttactataaacaaatcaagaacaaatcaagctgcacctttaacacttttttggaaatctcctcagctaggtatcctagtgccttctgcttttcacataaatgcagggcacaattccaataagatttctgcttctatgtgagaagaattccctgttctctagcttactgtaataattttatccctttcttctgagcctttactggaagcattctccaagtgcagacttctacaagctgtgtgttcaggtcagtctagcattgtctacatgctcctcaatgtttttccagcttccaccccctcccagtcatttaaacattcctaagttatttaaacatttttagataactagcacctcatttataatatcaaaatatcaaaattagtttcctaatgctgttctcataagttactacaaacttagcacctggaaaaaacccactaatttattattctgtatttctatatatcacaaatcctgtacaggtctcactgggctatgatcaaggtgttggcaaggatgccttcctttctgtagattttagaggggaaattttttcttgctcacttagattgttcacacaattaaattcctgcagttgtgagactaaggtctggtgttcttgctggctgtaagctgagagttattcccagcttctagaagttgtctacatgttttaactcctttcctccattttcaagtccctctcgtgcttcaaatgtctcctctctcgtataccattatcacatctctctaactgacgtttctgtcttctttctctgcttttaattgcccatgtgactacattgggtttacgtagataacccagaatgatctcactatcttgaggtctgttcattggaaactgtaatttcatctttagctttaacttccttttccattattatattcactggcatgatgttagaggttaagaaatggacatatttggagttgggggcattatttttccttacacttcaaagttgtttttaaatgaggttcaatttatccaagattatttctcaaccatttatgaaatcatgaataaaccctcagctgaactctgctaaaattatctcaaaagtagctgtgaagcggtaggctacaaaattctattacccttctttttacttttgtatttagtcacatccagtctcccttcatggagacacagaagttagaggagaacatcttttcccttccttgggttaacagttttgtctgcctccattcagattcaactcaacctacaggtctgagatccgccctactgctacaactcaatcctatgcactgaccactgactattgtcttgatattcttctttctttagatgagggcagatcagaagacactaagctctaaacttacatgggataggaaagtacatattatgttccttaccccctactcaccaatggaggcctaaatgtagccatcacatggagtacattgtctaaggattctgcactgatttttatagcctatttttcctatgtcctggattttttcatttttagttgtatattatcattgtagtcataattattacattattatttgtatgaagataacctaggatgagtatgatacacttccacattaacttctttcttgttattgtttggtaatgtgtaagacaaatctgtagtgatcagaatattctaaccattggcaaaatctgaaaaagtaatagcaacgatgagtctttcagttactggtaactagaaaagtcaaatttatttcatttttgggtggcaggggtttcttggagtacttgacatctgtgatatggtgaagtggtctcattgtgtggggtaacacctgaggtttgttgtctcatggccacggagattaaggacatggacacccaaagggtgaggtttagagcagaaatttaataggtaagagaaagaaaatatctttctgctacagacaggggtcccagaaaaaagggttgcctttttacagtttggatacagaggcttttataagaaaccaatagggggctgggtgtctcatttgcataaggcatgcatttctggtagttccaccccatcctagtgtgcataggggcccttagcttgagttactccatgttgctttgtttccccttattgcacatgtgccacacatgtgccaggggacagaattttccattgcaggcatgtctgggcaagtctcctgtgtagcctttcttatccacatggccatggggatgtcttaggcgagtcccctgggcaaggtcctttatctgtgcctacaacattatttttcaggctgttcttttgtttgaaagaatttaactgaggacccactgtaaaaccaaagacccaccctaactgtctgactgaccagtttcttcctttgccctctctcactggtacaagctttggcctccaatataaaacaagcaagtgagggtagctatcagcaggattagagacacacataggaaattataccttaatttagaagaaatatgtgtgtgaaaacatggaaactaagcagtcctgccatagagtatgtataaaacagaataaattgtattcctctactgtttattttattatttgttttatgatataaatctacaataatctactctattgttggtaaacatcttttataataagtccttttagaatcccaactttaacaataagtataaatttaataaagcattaaatattaaacatatatctcaagtaatttaataaagaaaaagtatcttgcacagagttttgttgacataatcatcctccaagagggctataatatcactgaaaacacaaaacagaagacagatgaaagtgagacggagtagcatctactttaaaaattgatggttattttaaaaacgtattcttgcaagccctaatttaacctgcagatacagaaggtgcaattacatactcctctgtgaatcatgagtttttcttatatcagatgtttatacttctaaattaatttcactcatttttttcaaagttcattcgcttactgaataaggtttactcaagggtttgatgtgctacgtactgcggtaggcattaaagtctttaaagtaacattaggtaaatatttaagagctaacacactgcaatcttactttctacctattgttatttagtctttattatatgctgatctttctacttgtaatagcatctccttatcccctgagaacttctcattatttagaaatttagaaaaatataaacagagagaaattttacatgtaagagccagcttaaacaaatattactagagatcacagagcatcccaccaacctaattatttttattctagaatacggaaaaatattcaggttttaattataatatagatgaatcattttgaaaatcaattatatcatctgctgaaaggatgatatattttgtgttgaattttcatagatttttgagagaagatgacaacgaatgatactcaaaggtgacacaccatttaccgtagattatttttctgggtctgatgtgggattttttttgatatatcatagttgtacatatttatgaattactcataatattttgatatgtgtttataatgtgtaataacaaagtcaaagtaattgggatatctatcaccttgaacatttattcttcatcttgaaatgttacaattcttctattccagctatatataaatatataataagttattgttaactataattttcctactgtattatcaaatactaaaacttattccttctatctaattgtattttcgtaccactgaagcaacttctcttcatctcccccattcatccttccctttccagcctcttattttttttttttactaaaagtttgcttgtgcacataaaaacagaagcaagcattgttaatggctccatattcaactttgcaaatagttaaatgataccagtatattagtgatattatcaaatgaaacatctgcaaatagaaagtcagttaagttcttccctgtcgtataagtagtttaattttttttttctaagtgatgaattctaagtcaaattcctgaaagttcatttccttgaaggtgaaatatctgaagttatcataaataatttataaaatttaagtacaaattcagcaataaaggtaatattagttattagaaggggataataggcaatataaatctatggagcagaaatatgcttggaattggttgtagcataaaactaattcataactgtgtcaaaataagatgcagtattctactgttcaaaatcaaatgttaagtgaccaaaatttagaaactgcttatatacacgattaatgtaatacacttgttttttgtaatgaaattgaggttgaatagttaaaattattcagcataacagtattttctatctttgttacctattatcaataagaatgtaatgatatttgaatttttaaaagaactactttataaatcatcttaggtatcatacaatgattgttgaacttatttgtatacacataaacatattcttaaattttaggtgacttttgttcaaaattatttgaaaatctttaatgagagcattcaaggaattcagcacaaaggagttcatatcttgaagctataaataaaataaaaaattatggtaaacagagcttatacactttgtggtactgattcctactaaagcaagtaggaagtaacaaaaaagcaaaagcaaacaaaatgaaggtgcaaatgtccatgagttaattctgaaattgctactttggaacatcttaaccagtggaattaatcctttgattaaccatgtattttcatttgggtacacctatataccctgtattgcattagaaggagatcacaggagtttgcagtatctaaatccagaatccttcaaaatagttgtaaatatacacaatttgtttgacaagttttagttgcaaaaacatttttaagaaagtttttgaatcctggcaaaaatctatgaaagtactggggcttaagtgtttatatatttaactacagaaatagaattgcaaatatcctctatatagcagaattttctctaagcttatatttccacatttatagttaccatattttcttaagaatgttatggcatacaagaacagtcaattaaaaatataaacattgtaaatttgctaattataaaatacagctttaaatactatgatgccaaatgttatgaaaaaattaaaattacacatctatacaaaaataaaatttttagaaacatactagtggtataatatcagagaggaaatctaagaaactgaattaaacatgccaatattattttttaatgtattgaattgtattattgtagcattcaaataattcatatgaatactttcaaaatattttaatttactcagtgttgtatatgttatttttagaaagttttaacttcgaaaagttgtttgaataaaacatcttatatgttcattgacataataaaacaaattttcttgctgataatttttattaaaaaatctctttatagaccctcatttattttcagatgtgtttaatataatatagtatggtgaacatactgatatagaactaagtaacatctttgatggtccaacaacataatgaacaaaacagccattcataaactttagtagggattggatttgggccctgatataccatgaatttacaatgtaaggaagcttagtagagagacctagtctagaagagctggatttctacttggcttacggcttctccagtgggaatgtatattgccaagtgacactcactgagggaaggaccagtgatccccaaaacaaaatctataaaactctctaaatacatatgtatgacaacactgttttggttattacctattgctaatatttcctgtaattcatgtcctcttttggttgaacattcatgaccacactgtccttagaaaacctgaactagtttctgaaaacttcatttatggtctagattactcaaacttaacctgttcctatgatattcaaattaatgctttcagtttggttctgtgggtcaccttgtgttgtttaattgacttgataactgctatgcttgggccatacgactcctgtctgaacttaccttaagctacctgggagctgtctgtcacaagggtcaaatttgaggatttaaaaaattttgtacttaatatgctctatgtattatacatttaccatatcctgaaaaagccatggtcatctgagaatctcatttgtggcagacaggagggactgacctcttttataacttgagcttatcagtgtccactctgctagctggcagaactagtattggtttagcctctatatgaagctgaagtctttccaattcccagtttgtcttttcaaacttaaagcagtctatgttacatatattcatagactgaggagtcatgatgtggttgagtgacctcttaacatagtcctcagcctgattttatatgaaccttagactgttcatagctgttaataagtgacctctagagataaacatctttaggaaataaacatccccaagatatagacacctttaagacctaagataaaatcccaggtcagtgatttggtttggctgtgtctccacccaaatctcatcttgaattttagctcccataattcctatgtgtcatgtgaaagactgggatggaggtaattgaataatggcggcgggtcttgcctttgctattctcatgatagtaagtctcatgagatctgatggttttataaaggagagttcccctgcccacgctctcttacctgctgccataaaagatatgactttgctcctcattcaccttcagccatgactgtgaggcctcttcagccatgtggaactgtgagtcaattaaacctctttcctttataaataatgtagcctcaggtatgtctttattagcagcgtgagaacagactaatacagtcagcttcagttcagtcaagagctttataaaggaatccgcaattctgaatgaaaacccttgtgtcaaataaagaacttcggtattttctggtattttccagatactactattgttgcaccccctctcctctacccctgaagaattctcttatttactctgaatgttagctttcctggactttgtgacttgctgggaaggatttcccttggaagatcctgtcccccattttcagtatatgtctctcttcacttgctcaagtgaggagagacatgggctttttaaatttaactgttattttaacttctttatacctacccattactaaatttgtcagtgttctaaaaaacaattaaaaataaagcttcaggaaatcaataatgcacttcagttagtaaggacaattctgtgtcaaatgccttattgtgttttgttggtaatagtaagtttaaataattatttaaacaaggtcaaagaatgataaatctatctgttcacaactgtaaatatttattcaattgctgagatttatcttgtgtcagggttaaaaagcaagactgctcttctaatagcctactattattttaacgtatacatttagcttgttgctaaagaaaataggctaaaggatttttatttatttatttattatactgctattcgacaactctaatggatgcttcaagggaacactgaattcctgcataaaattttgtagcatattttatgagttgacacattgtttcgagtagtaagctcaatgttgcgtgaaaggcattgtatgtgtgagttctttgtgaactggaaagccataaaaatcagtttattccttttttttttaacaagtgtttctgaaagaaaatactaatgttacatttggataatttaaacaaaagtgaagtttgctttaacgatagcatcagccttcaagaaaaaagacttattcacagatataatatctttgtcagctttattgatcttaactaacaataacaaagataatggaaggttttttagagtatgaaaaataaacatatcggggctgatttattttttaaataacttaaaaaaatattgcttctgtcatatcatctgttccaataacatttctagttgacatttatattggaagtaaattttaacctgtaaaatgtctctgaaatccattcagaaataaaataatactatctacatttatttggctattgaatttttgttgccattatagtgtgattccttagaacaatgctatgcaaaacactttcagtttcttcaaggcacgtagtgctacacagtaggagggctaaaacaatttatgaacttgaaaagtcaaaacactgaattagaaaaacaatgaagaaaaagaaaaagcaaattaaggacacaaagcaacaatcacaccatgagcttttagagtagggtacgcaataacatacagcttttggtttttgaaagacagtgataaaatagagggtatataattaaatcctaaatcaggaaaaaacaaggcattttctgtttatttgggattgtcttttccttttatgttttgagtcacatttcaataccttatcaaacagcagtataaacagtctgaattatatagtgagcaatacctaattgaaaatgcgattttatccatgttaataggataacatataaattaaattcaggaaattattgggtctgttacccacaaaatatggaaacacaggatcataatcatgtaatttaaggtcataaaaggcatctggtctcaatcttcagcatataaagttatttaatttgttcattgaagacttgcattccttattttgaaaatatctcattttttcataattaaagataaataatccttcttatacaaaaaaatcaatgtttaaaagaaatgtaaaagccatgtgttctttctaactaaaagttatttagaatattttcaaaacagatcacttacgaaattttatttttaagtaaatagtatttttctcacttataagtgggagctaaactacaaggatgcaaagctataaaatgatataatggattttggggactagggaagaagaggttgaaggataaaagactatcttttgtgtacagtgtacactgttccggtgacaggtgcaccaaaatctcaaaagtcaccactaaggaacttatccatgtaactgaaaaccacctgtatccccaaaactattgaaataaaaataaaaattaaagaaaaagaataaatagaagattttgcaaggcaataattttaagatctttaagtgtaaaattttgatatatttgtcttaaaaaattctctaacaagcaaaccacaaatatctactattctagaaaggttttctgtttaagctggggtttttttgtaattacaaactttacattttgatgttgaataaaaataaatacttctatttcattcagcaagcgattattagtccacatgagaaatataatgtcttataattaattaagagtagcttttaaaaaagattttaaaatgtttttaaggaagtaaattaataacagtaccaggccatttaaataaaaataaaaattaaataaaaagaataaatagtaagctttgcattttaagatcgactgtaatgacattcaacttgccattttaattttatacttcttaatctttttattttatgataatttttaacttacagaaacttgcaagaatagagcaaatcatttttttttctttccaactttcattttaggttcgggggtacatgtgcatgtttgttacatgggtaaatggcatgtcctaggatttggtgtacagattatttcatcacccaggtagtgaacatagtttgttacatgggtaaattgcatgtcccggggatttggtgtacagattatttcatcacccaggtaatgagcatagtttgttgcctaggtaaattgcatgtcctggggatttggggtacagattatttcatcacccaggtaatgagcatagtactccactggtagttttccaattctcaccctcctcccactcttcaccctcatgtaggtcccagtgtctattgtttccttctttgtgtccatgtgtactcaatatatagctcccacttacaagtgagaacatgtgctatttggttttctgctcttgcattaatttacttaggataatggcctccagctgcatccatgtttctacaaaggacatgattttattcttttctatggctgcacagtgtttcatggtgtatatgtacaacactgtcttattttcccccatttaaaattcccttgtttttaacttttattttaagttcaagagtacatgtccaggtttgttacctaggtatacttgtgttgtgggggtgtgttgtacagattatttcatcacccaggtattaagcctagtacccattagttatttttcctgacctttgtgctccttccacgctccagcctccaatagacctcagcctgtgttgtttccctctacgtgttctcgtcatttagctcccacttacaagtgagaatatgcatgtggtatttggttttctgttcctgtgttagtttgctaaggatagtggcctccagctccatttatgttcttacaaaggacataacctctttctttattttctttatccagtacaccattgatgaacatttaggttgatttcatgtctttgctattgtgaatagtcctgtaatgaacctccgtgtgcatgtgtctttaacgtagaatgacttattttcctttgggtatatattcagtaataggattgctgggttgttttaagttctttgagaaagctccaaaccactttgcacaggggctgaactaatttacattcccaccagcagtggataagtgttcctttttctcctgtaaccttcccagcatctgttatttttttacattttaataatagtcattctgactgcaacttgccattttaaatataaactcttaaagatcaattaaaaatacgttattactttaagaatatctgaaacacctaaaatttccagtaactgctgctgagggacaatgaccattcaatggccatagcattgtgcaagcatgtttttcagggacatctgaatatagactccaataattttctcacataaggatgttttcttgttgatgctgaattttactcaagaaccagagagcccagcatttattattatcagcatatcttctgcattatttatgtgagtccttcctgaatggatatctaaatgctaaatataaaaaggcgatacaaaaaccataattgatctttctagatctggtgagacactattttgcacatttgcatcactggaaaccaggtttcttctcttagggcccctggtaaccaaaagagactatgctaaatatcctgcatctgtggccatcttctttccagttttaagtttatagaataagtatatatctgtagttttcatgctaattcacagtatttttctccaggtgttgagtggattatactatagggtgacagcaccctcccaatgcaacttcttcatggtttgagttgaagctcagacttagtgaatttattgacaatgtgagaagtgacaggtatagtttactggtgcatcaggctctccatcattcccttatacttgagttttctgcatctgtaggtccttcacctctttatctacacacttaattatactgagtagctttctgattaagatagtaatattagttcgtgatccaaaacaatgaaaattgggaagtaaaactacatggaaagaaaaccaataacttgtaaaatgaatgcagatagaaaacaagtttttaaataaacaaaaaacgtactaacagaaacaataggatatattagcaatatgagagaataagaatttataattaaaaggcaagtattaatatgaaaatgatatagtaagtgataccagagcctaaacaaatggtagaatgtataaagcaaaaagactatttttcaatttaaaaaaccaggctgagaaatagccacagaagtaaagatagaaatatatatatatatatatatatatatatatatatatatatatatatatttatgaaagaagagtttaaaacatatggaagatagaaattccaaaattcaaataacagaaatcctggagaaataaaaacaaagaatgaagagttagaaatatttgaagaaacatgggagatatagtttataaaatataattcagaaataaatgtatagacattaaaaaataaacaatgtctgattgaaaaaaattatcaagtgctattaaataaaatttatgggatacagttgatttggactaggcttttgcactaagcctaaaaggccaaaccaatataaagttaaactacagtagctgagctctacttaattgcaggaggctttgtacccaattaagctgtaactaattaagttgtatttacaccacactttcatttcctataaatgctgtcagatcgtgttattggttggagttctctgaacttgctttgattcagaggactgcccatttaagaattgtttatgttttgtttgctttgatttgctctggtttgtattgttttcctttgctcaaactcagttaaaatttaaccctcatctaaggtatgttttctgtttacaagtcccaaagagtattaagaaaaataaaacttattattaaaacttagtgaatacagaagacaatggaaaatgtgtaaagataattcaataagaaagaacagaactactacagagcattagacttcttaactaaagcactttccagatgaaatggaggcatatttttgatgatttgaaggataggaaatttgaaacttaaatttaatttttaatgaaatcgtcattaaaatatgagcacataatttaaatatttttaggaattaaagaccacagaagatttaccacataaaacataaaagtcataagcaaaaccttttgagtgaattatttaaatacaaagaggaaaatacctccaggtaacttatgaacttatgtcagtaagtttaaacaaatatcttgacaaaattggctatctaaaaatgcatacatacatatgtaggtacacacctaagagaaaagaaaaaagagagagtctccataacaaatcagccttaatatctataaaatattcacatagcaccagtatgaaaggtgagtgagtcctaggatacggacatgaaaagataataaaatttgtggtttttgaggatgacatagatcacttttaaggtatgctatttaaaagagatgcaaataaaagccaagagaatgaaaaatttgtatatggacagaataaagatataatgagacaatactaaccaagaatgctggtgtagggatatagatacaacaacttttacacgcaaaacttgtcaggaaaataacacaattctgaatatatattgtagtaaatactgagtgtgccaacgatccttcatcttcagtgctgaagcactaagcatcctgttagaaatactagtagcaaacagcttgcaggtgaattcacctgattattgccctcaactgaagagtgttgacttgtctgaatccacacccacaaccaatgactggtcaatgcaaaagcagaaaagcttgaattccttgtcttaatttgggtatactctgcagggcccatcctagcatcagagcttcttgtggaattgactgaggcctttgttatgaccacatcacagctacttgctccctgcgctagtgataatattaagagtaattcctgaatgcaaatctccatctccgagtctccttcatatgggacttgaactgcaacagttggtgcctgggttgctaccagaaagcagatgctaacatgatactttggaactgatcacttgtgacccagcaagcaataaaaactccatcactgatggtagatggaaccctgagggcacatgacacatggtggtatgccaatggttaaaacatttacttctggtgaattagaatggtgtaccacagaagggtatgcactagctagggcaatgcatcaaggatatggttagtctaggggcaataatagtcacaagcatgatggaaataggtggctgtttctggggcaattgatttttcaaaaagatacaattgatgacagcaatgggccgtccagggcagctactaccatgatgctgactggagcagagaggtgcgagagatgatggcagaagtgactgcaggagcaaggatggtgttattaggtggtgggatgttccctgtgccctgcatccctgaggcagctgactgtgccacccccaccctctcatggctggacaggacccattcccaggtctggaacctccaccatggcctcaacctcactccccaccacatcctggaggcctgcgagcatctggccaaaggtgcagccaggactcgtggggctgcccctggaagcatcaggttcatttgtatggggttggctggggccaccaagacacttgcacctcacccactgccctgggagccgcagcaatggagctgagccaagtcacccaccagcgggggagcagtgcagttgttcacaaaagggcaggcagagcagggccctgaggtagagctgggcctgagagggtgccatgctctgcagagccagtgggagctgggagcaggcaggagccctgccctcctgggcatggctgcagctgcccaagttgcaactgaggacccaggcatctctgcactcttgggggcccaggaaggtcccttcttgcccctgtgggtttggagatgtctgctcctgctgcctggcctctctccactgtcagtgcccactctgatcacagagcaaagttgaggccaagcctgggtgctgttgcaacctggccagatgtgcacatcctcagggcagtgctgatatgccagccccctgccatcttggccccctccagactttgggtaccaaggagcatgggggggagcctaaggaggggttgagggcagctcagcgctggccttcaggtgccccttggcacaaacagcctgggcatcacagatggcagcaccctgggtgcaatggggtgggtccctggtgaagccccaccttcaagctggggaaagcctgaagtctgggggctgtgcttctggtcccatggaccagaggggaaacttgtggtgccttttctgggcctacccatggctgcccatggaccagttggtgcactcttcttcccctctgaggcccataaaagtcccagactcagccagactcgaggagatgatgggacaaccagctgcagagaggaactaccctcactgggatgacctgtccaacagagaggagctatcccctctgctgagagctgaggagacaatggccgaccagcttcagagaggaactaccatctctgctgagagttagacactcatttggatgatctacctagcagagaggtgctaccctctctgctgagagctgaatactcattgggacaccctggctatggagaggagctgcccactgagcgtctcctctgagctgttctattgctcaataaagctcctcttctcgctcaccctccacttgtctgtgtacctcattcttcctggattcaggacaagcacttgggacctgcagaatggcagggctaaaagggctataacacaaacagggctaaaacatgccccttgtctgccaggttgtgggtgacaagaaaaagagaagagagaatgagagaagagctgtggcccttcagggagcccagacctatgagctccccaaaccagggctgtgacaccttctttaggacttttcagttcctggtgtctccaagcttctgggtgccacattgtgatccccaccatcagctttggaagctgcttatagtatgcctggtcagccacagccttgcagggagccagcgcccatgcccatgcctggacctgcctgccctgctgcggctggcatgcctggctgtgtgcagtgcttggaccccacacttattcacacaccctttgccactctgtacctggcttgcccttgtcaggcatgggatccaggccagcagtgggagctgagtgcaggctgtgaggccgagtgtgtggaatgagcccagtgggccagagcagaaacttgggcaaaggctctgctggccacagaggtttctggctggtgaagcaacaccctaaggatcctgtaacacaatgaaaggtcaagggtaattaatcacaattaaagtataagtgtgaaggatagagtgagaaataccacttaaggaaagtctactttttttctttatgaaaagatattccctttctgatgcttagttttatccaagaacagggagagcacaaggttaataaaaatgtccttaaacagaagtgtttcaactattggtgtaagttatttctgtctggtgattcaagatgtgagtcaaaagaggaaatttgatagtaacagttgatcttaccttgcacaatacatgtcaccagcatctgtgttcctcttgttagggactctggggaccaagataaattatgcagaaaattgatgcatctaattctgccctaagctgtcacttcacatctgataacaatttgtacttgaagaaaattattttggaaagttagcataaccttttactctgtgcaagtgtataattttgctatcaatccataatgtacctgatactctgaggctaaaattttacatattactcattgaaatgtttactcggaactttgtgcatattaagttaaattttatttttatacacccatttgcaatgaattcaagcaaacatttataattacttgtcttgtagagatccaagtgtccctctttgccagctgttaacctgaggccagactaatataattagttttgttaattacttctagttcttcaggaataattgagattattgcatccttacttcactctagaattaaattgatggattcttctcatgtgagaacttgtgacctttaagtccacctactcaaaatttgttctggaactaattaaatatatatatttttcagtcttccttatctatagaaaaacataataatcaaaatgctccaaagcacgcttaaatgaaagatactcaagtatgttactcacagtgaggtcattagttttaaatatttctgtttttgtgtgtctgtggagaaagtttctctctaagacacgtgcacattgatttatgaaatgcacagatagtgatagatagccctaaaatacttaagttttgtcagtgtctctcagtgtcagtgcacatgtacttatgtaaataactacagtttcagtttatatttcaaatactctctcaagtcagtaagtgtataatcagcatttaaccatagctttgttagaatttttccctcattattcttggaattgtatatagaagtatttaataacattgactttgatattagatataactgagttttcttgtctctcctacttattagatggatttctgtggactagttgcttaatcttgaatccccttatttttcatttaaataattgggatgatgtatatcatttttaactgactaaaaaggataatcaatataacttggtaatctaaacatcaaaaacatccaagaaaatataataattcaaaaacaattatgagtagcctttatagaaaatgaaacactacaaaaattgaaagacggccacatgcggtggctcacgcctgtaatcccagcactgtgggaggccgaggcaggtgtatcacttgaggtcaggagttcgagaccagcctggccaacatggtgagaccccgtctctactaaaaatatcaaaattagcactataaacttttttcttaacactgcatttgttgtgttccagaaattctcgtatattgtatctttgttatcattagtttcaaaaaatgtcttgatttcaatcttaatttcattgtttaccccaaagtcattcaggaacgggttgtttaatttctatgtaattttatggttttgagcgatcttattagtattaatttctacttttattgcactaccatctgagcatgtggtttgtgtaatttgggggtttattttgacattgttgagttgtttttagctgatcatatggtcaatttttgagtatgtaccacatgcagaggagaagaatgtatattctgctgttgctgggtgaagtgttctgtaaatgttttatatgtctatttggtttagtgtcacattcagatcctgaatatctttgtttattttctgtctcaattatctgtctactattgtcagtggggtgttgaagtctcccactattattatatggtaatcttagtttcttcattggtcactaataatttgttttatgaatctgggtgccccagtgttggatgcatacatatttaggataattaattcttcttgttgatttgaactctttattattatgtaatgctcttgtcattttagaattattgttgctttaaaatcttttttgtctgaaattagaatagcatcctctgctctgtttattttccatttgtttgtgatatttttccctatttccttactttgagactaggaatatcattgcatgtgagttgggtctaagacaggatacattttgatcttgcttctttatccaacttgccactttatgcattttaagtggggcatttagctcatttacattcaagattaatattgatttgtgtagatttggtcatatcattgtgctattagctggttgttatgcagatttgactgtgtatttgtttgcagtgtcagtagtctatgtccttaagtgtatttttgttgtggccagtagtgatctttaatttccatacttagcacttccctgtgatttcttgtacagcaagtctggtgataattaatacccttggcatttggttgtctgaaaagaatgtcatttctcattcacttatgaagcttaatttgcctggatacacaattcttcgttgaaatatatcttctttaagaatgctgaatataggcccctaatatcttctggcttgtagggtttatgctgaaaagtccattcctagcctgatgggattccctttgtagtcaacccacctcttctaagtagctttctttaatattttttcttttgtgtccaccttggagaatctgatgaaaatgtatcttggtggccaggggtggtggctcatgcctgtaatcccagcactttgggaggttgaggtgggtggatcacctgaggtcaggagttcgagaccagcctgaccaacatggtgaaacaccgtttctactaaaaatacaaaaattagccaggtgctgtggtgcctgcctgtaatcccagctactctggaggctgaagcaagagaatcacttgaacctgggaggcagaggttgcagtgagctgagattgtgccattgcactccagctgcctgggcaagaagagtgaaactccatctcaaaaaaaaaaaaaaaaaaaaaagaaagaaaggaaacatgtcttggtgatggttgtcttgtatagtatctcccaggggttttatgcattttctggattttgatattggtctctctagtgaggttgtggaaattttcatggacaatatcctcaagttttttttgtattgtgttgtactgtattgtattttattgttttgttttcattgcttattctttctccctttctttcatggatgccaatgaatcataggtttggactctccataattccatatttgtcagaggtattttttattccttttattcttttttctgtacttttgtctaactgagttaattcagagaaccagtctacaagcccttagattctttctttagcttcatctattctgctgttaatacttgtgattgtgttataaaatcattatagtgagtatttttagctctatcagttcagtttgattttttttcttaaaatggatatttcatctttaaggtcttatattatgttattgaatattttgtattctgtggattgagttttgactttctcctgaatctcgatgatcaccattcctatctatattctaaattctgtctgtcatttcagacatttcagcctggttaagaaccattactaggaaactagggcagttgtttctttggaagtaagaagacactctggatttttgagttgccggagttcttgtgttggttcattttcatctgtgtgggctgatgttcctttaatctttgaagctgctgttctttgtatgggtttttatattataggataccctttggggtttgactatggtataaggtggcttcagttgactagcttcatttctggactatttcaggggtccaaagctcaggtcaacactccagggctgcatgctataaccttgaatgactggtatcaggtccccatatttgttctctggcccctagaggttaaacgcttgctgtgctggaggagccaatgagttctctgtctgctggccacaacactctgatagggagtgccaccccagtgggtgtggtggcacagcaggatatatgcatgtgctggtggggtggtggtggtggtgcttatacagggttggggttgtggtgtccacaaatgcgagtgtataaacagcagtgtcagctcagtgtggtgtgcaggcctcagcaaatttggggtggcagcattcgcatgtatgcacgtgccagtggcagctgtttgcttggtgtatgtgtcagccgagtggagcagtgaggtgcttgtatgcacactggcaaagcagtagggtggggctgttggcaagtgcgcaccagcaaagtggttgggtaaggctggagtagggggaggctgcaggtggttgggtgcatgtccacagggaaccatctgcttgaatccctgatggtcaggttcagtctgtcagtgaaggagctatggcagtgactgtcaagacgtaccctggttggtcatctgaggttgtgctgcaaatgggtgcaaccatgcagggaccctaggagaagtcaatagacaagggaatgctcaaatcagactggccccattccatggacatgaccaccctgctctgttgaattttgatagtcaagcaaagccaaagccacctagaggagcaaggtgaaccttagggtttgggcctttctgtccatgctcccttttagccattctcaagccaaactttctgggctccatgcaggctggagtactgtctttgctacatctcgaaacagctttccctgtttgcgaattaaatgcaaattaaaaccacaatgagaccatctcaccctagtcaaaatggctattgttatcatatttaaaataacaaatgctggtaaggttgcagagaaaagggagtgcttataccctgctggtgagaatgtaaattagttcaaccagtgaagaaagccgtttgtcaatttctcaaagaacttagaaaagaactacctttcgagccagcaatcccattattgggtgtatactccaaggaatataaattgttctactataaagacacatgcacacataggttcattgcagtgctatttgcaatagcaaaggcatggaatcaacctaaatgcccatcaatggtagactatataatgagaaaatggttcatatataccacggaatactacacagtcataataaaaaatgagattatgttctatacagcaacgtagatgcagctagaggccattatcctaagtgaagtaacaaaagaacagaaatccaaatatcacatgttctcacttctaagtggcagctaaacattgagtacacatggatacaaaggaaggaacaataaacactggggcctacttgagggtggaggatgggaggaggatatcaaaaagctacctatttattactatacttttatctgggtgataaaataatctctacaccaaacccactcaacatacaatttacctgtatacaaacctgaacacatactcctgaaactaaaataaaagttaaaaaaattaaattagaaaaatataagagtaaaatgctattttaaaatattcaatgtaagcaaattaagattttaatgtatattctctataaatttaaataatcaagggtgactttttatgtttattctttgaaccaatgagaccaaatgcaattaagttgaaaattgtattgcaaacatttctcaaatccaaaaatatattgatactagttcagtttttttaaagttgacacactattatggaattttaaataaatttaatttgattagcatatataacacacatgcaaattttgaaataacattgaaattcagtcatacactttcatcattttcagtgttatggctaatcttatgagagaaataatagagtagattattaagtggcttcatatatatttcctccctttggaatctgagtctcacttctgtggtattagtactttcatctgcagagagcataatgagatttacaagttacgaatgaaatttatatgcctgctgaaggaaagctatctcatgtgtataaaatgtacagcaagatggcaagaaatatttaaatgagggtactacaaaatcatactaaaaagctttgaaatttgaggacaaactgtttaattggttaaagcaggatgtccccaggatgtagttaatatttatcaagagatcatgattactctaaaatgaagttataagatttggttttgttttcaagtatttgaattattgatatggcagaaattaataaaagtatgtgtcacatatttctctcccagatcataagcagagtaccatttattttgtaaaataataacgttgctgctttttcactcccatagttcggtgagtgggagtgttacagctcttcttttactcccatagtttggtgagttctgagttcttgtcccataaccaagaagaatgaggtacacagacactagagagtgagtaaggcagagtagaatttattgaatgacagaaaagctcttggtagtgagaggggacctgaaagttggttgtcagctgtgaggctgagtctaggggtttttatggacttagaatggaggaaatatgtgctgactggtttgtgggtaggcttggaaaaaacaccattcagaaggaggcacaaaagggtatagagccaattgggggagggtagatataagtaaaataggtgaaagataaggaccaatcaggaggaagcatgccaaatgggaatgggagttctcactccagtccatggattttatctggagctggtagcttggttttcaggctttagatggtccttggcttgaaggttgagtttcaccagaacccattcctgtttgcctaggaatttgcctgcctcctgttgctatcaataatatctatttcaacaagtatgaagagttcaggtctatgtactcaataggaatttactatgctctgactgctatttattgtttttctgcttttgttatgatgtaggattagaaacaaagaaagtgaatttttaaaacattaagttaccaaaatcttagatggcttgacatttaacattatgattatctattttcattatgtagatcagtggatatagaaaacatcaggaaaaatgagttaaatataatttagtctatgaattgaaaatatctgatatccaaatgttctacacatatgcaagtcttgcttattactgttccctttcctgggcggttttcagtggtgatggttggcacaggaagtatctattggaactttttccccaaaactgctgctgttaaccccatcagagtaatgatatccatggtacttctttattcaagtaacactcttcacatttcttgaaagaactgagtctgaattaggaggttattttgctttgctttaatatcaggtcattaagttttggatttgatcctggtaacctgtttctgatcaccctctgtcctgcctgttttgaaattattaccttgttggccttatagtacagataatgtgtcatactcttctgaatgtcccagtagactatgcagttaatggcctgtctaacaacattctgagtgttgatacaccagaattcaccatccttccactccatgcatctgtcacaaaaaatctcactggttatattagatcctataatgtcaccatacttttcagatataatgaatttttatcaccatgatttgtactgtactagctgtcccagtgctttgcctgttctatacagtaggtttacctgaaaatctgcctcttattctgccatgggacaaaatgctgaattttggcagagtgcaatcagggtagcaagaaatgatgaaaacttatccatgacattcctataaactagaagaagcaaatattatagaaaggatttttctcttttgtttacatttcctctttgaattttaaaaacttcttcccacacgatttttttttcaattatagtcaacagctcttggaaatgatgatatttgtatcactgaaaaaataaatatatcaatgaatgagtaaataaattgttttggcttatgtcacataagatacagactttgaaattacactggaggatttttaggttaatttttctatcttctttgtgaactgacattcagttatcaccttttccatcaacaacagcaatattcatgtacttttctataattctgattgtcagttctcacacatctcagcttcacccaactgtcatttcttatttgaacaaatggtatttcaattctgttggagtttattttaagttagtttttattatgagctataaaattgtatttcccatttatattcaagtcttcatttctctcgctcactgagctctatacttcctttttttgagatttggtaatactctttggcggcgaaaagcaaataagtatagttatcaaagattattttaatacatataattcagttcttccccttaattattcctgcttaatctagtgatgaggtcaaagccatttacacagatgtaattatctatctatatataataattataagttgtatatgttatatgtaatcattggtatgtgtatatatacagtcagtcctcattatttgtgaattcatatttgtaaatttgccaactcacttatatttctgtgtaacccgcaaatcaatacctgtaatactctagcagttatttgtggactggcacagagcaacaaaagaattgtgtcacccaatgtgcagattctcagctgaggctgccactttgccttcttctctcacctttgatactgtaactcgttttgtgctcgatttggtgccacctttttcacatatttgttggtgatttcacttttgaaaatggccccaagaacagtgctgaagtgttacagaagtcaggcatgagttataatacagaatcccaaaaatgtgacaaaaatgtgaccaggggattgcagtaacctgactctgtattttgcctaggagcaatggttcaggattccctatatccatttttaaaggactttgtagacaataaccaccatgtgtaatgaggattgactatatatgcagagagaatgagacaaggaactcagtcttggcttatatcacttgctgtggattaattgagggaaaacaaagcaaatctgttttctacctacataccaaaaaggagaatggaaatcttaagaaatctgggctttccttactcccagtcttcccaacaaccagtgaatagatgttatattttagaaacatgaagagataataaattctttcagcttttaggtggaagagaagactaaaatcttgagtttatggacttgaagggctcaaaggtagatgtggcttctgtgatacacattgggaagtggtctctagtggaaaggtatttttgcccaggttacacacaacaacccagtatgtggccaggtcactaatgtgatagtgggtgaatgcttgaggtatgaataccaaccatcaatggacccaaagaaggttctcatggtcaaatgtggcacagacagagtggagcttatttgtcattgaacaaacgctaatggaagcttggacaaatcatctcagagcagactataatagcttaaacataagagacacctctttctccaaattttaacttttattgtattatttttacatgcttctcaaggcttccaaaacttctgtggggtaccagtggtttctaggtttattggaaaatgtttagcaaaattatatacatgtgtacttgtgtttgcatttgtcatttaactccctgttttacaaggttattttttgtcacatttcctttggtctgatcaactttaaagccaatcaatttaaaaatcttttattgaaaatatagggaatgagagcatttaatggaacctctgaaactataatatctcttgactgagctccacacactattattgtttcaagtagaccagtttaaaatcaagcactttaagtagatcacacctcctccagtaaaacaaacaaacaaaaaacatagtgatgttttgtgatttttttcctcttaattggacccagtccatttcctggatggtttattttctcatgtgactctgctcagtttctttagtgacaaacagatactgctcagttttagttaatgcactcttactactgcttgtgggcaaatgattaatgtacagtttataatccctatactacaacttcagaaaaataaatcctttggttcctatcagctgctaaattagaactataatgctttcaattacttttcatgaatacttgtttagtagctactaaatacaaggtaatgtaacatagtttattttccctatagaatatttttcattttatatttgttcagcttattttagaaatatgaaaactatatttgatgtttcgctcctaatcaggtaatctccattcattttatttttaacgaatttgaaataattctccataaaataatatatctttaagaatattgaaaaagagtagcaataactattgaaaaatgataaaccatgctttattctagtacaatgtatttaaacaataaaatatatccactactctttcaagcccttcaacttcagaacgtcataagccacataatacacacatacacacaaagacacacacatgcacacatacacaaacaccaggtataggtttgaaaagaagcaagatatttaatgaaaaattgtgttttctcattttagtctatttatccaaatggcaatgctaatttttgctacagaccagttactgtatgtgaaaattcttctaaaatgggcctatattttctttaaatgtacgtatttttaatgttagaagtgagaatcccacaggaaataatgagcatttagaataattatttcctcggaggccttttgatgtcctaagcactcatggaccattttttaaaacactgttgtttaaggaaagtgaacaaatattaattgttcaataggcaagttctgcagtctactctctttgcttgactttaagaactgtttaaaacatgttgagtaatcttagaagtggtgggttaataataaatttccttagcttaattatttcattcattgtcaatttgcatcattatagtttaagatttagttcaaccttttttagtgacagtagagagtatttaatgtcatgataaccttaaaacatcaaatttagccattttattttaattatttcacttatgggaacataggcaatagggatagggcatcaatccaaattgagacaagccaagccacaagacttaatgccagttctacagagattcatttctcttggtatgttgaggtaaacacactgttcttttctgttgggaaacaagtcttatacaaagcaactcatcaaattgatcagagtcttcccattattgtaaaagtttattcttttagtgagaggcaaatattttaacatatttaacataagcaaattttgacatacctatcacatacattataattatgacatcttaaaaatttaatggataaacttaatccctgcaagccaggtctcactattttaattactctcttaatttcagaagatggttgttaagcaaatagcagttatttaagtcagctaatatatgatattgaaagtaaatgtatatttatataacaatcacatctaaaaatgaaaataaatcactttctatgaaaagtattaataaaatcataatgactgatctataatacaatttcattgtcatgtatattaacagtacaaaagaagaaaaatatattcgtggtgacttacaatattatatacaaatttttgctttaaagtacactttgattgtttttctcaattttttcattgaattttaaaaaatttatttggcatggtagtgaagggatcatgacatatctataaagaatggaaaaataaatattttaaatctgtatttgaatgaattatgaatgtattttatcaatatttcttcataattatactctaatattgtttttatttagttgtaacaataaaaaaaatgcttttttacattaatttccatgtaaatatatatgctgcttggaaagcacaaatattttttgacactcccatgtttaatgtagcactattaacaagagccaatgaatggaaacccacgtaagtgttcatcagcagacaaatggatttgaaaaatgtggtatatatatacaatggcatactactcagccttaaaaaaaaattctgtcacatgtgacatcatggatgaacctagaggacattatgctaagttaaataagccagtcacaaagtacaaataccacatgatctcacttatatatagagcctaacaagtcaaattcatagaagtagagagtagaatggtggttagcagaggctgaagggtgggggtacacaggaaaaaggaagatgttggtcaaaaggtacaaactttcagttacacaagagaaaaaaatctggtaatatattggacaacatggtgattatagttcatgatattatattgtagatctcaaaattggtagaagacaggattttaaatgttcccgccacaaagaaataagaaatattttaggtgacgaataggttaattagcctgattttattattccataatgtatacaagtattaaaagatcaaattgtaccttattaatatataaagttaatatttgtccattgaaagtcaaataaaacttaaaaaataagcacagaaactatagataatagtgtcatacaatactatattttaaaatattttgattgcagacatatacacctatgtaataagctaaatatgattttgctcataaaatgtcctatttaaataaatgccttaatattttcaattgtattaaaactataaatacatataaatcttagcaattatttcactaagtttatcttgtatttattttgtgactgtgccaggacaatttaggcaacatggaacagttagaattcaatttgtgagatggtcacctcttttaacaaatttattctgtgcagcacacttaggagtaggtaaatgctggtgcatgggttaagatacaaaagtgattattttaatggaatgcaaaaagtgtttccctggctctgcggaattgcattttaaaggcacccaaagagctttcctttgagaaatcagaagaaattctttcaaagacttcccaactttcaaagtctttaaacctagcaccattatcaaatatccccacaaatattttgtatacctttattaaaatgtattacaattcagaaatgctgtttaatcaaattaatttaaatcttcagaacaacttctgcagactctttaaaatatttttttttttcattgtgccttttcctggttttggtattagagtgatgctggcttcacagaatgagttagggaggagtctctcctccttgactttttgaaataatttcagtaggatgggtttcagctattctttttatatctgatggaatttgactgggtatccatctggtcttgggcttttttttagttagtaggttttttattactgattcaatttaagcacatgatattggtctgttcagggtttcaatttcttcctaattcagtctggggaggttatgtgttcctgggaatttatgcattccctctagattttctagtttgttacataggagtgtttattgtagtctccgaggatcttttgtatttctgtgggattggatgaaatgtcttgttgtttctgattgtgcttatttggatcttctctcttttttgctcggttgatttagctggtggtcaattgatcttgtttgtccttttaaagaactacttttctagtcccttgaggttcaatgttagattgtttatttaaaatctttctacttttttgatgtttattgccatacactttcctcctagcattgcttttgctgtattccatagatttatggttttttgtttgaatttttatttttttaatttttaaaattttctccttaatttctttattgacccaatggtcattcagtagcatgctgtttaatttccatgtatttgtacagtttccaaagtttatcttcttattgatttataattttattccattatgatctaagaaggtacttgatatgattttgaatttcttgtatttgttgatacttgttttgtgacataacatatggtctatcctggaggagtttccatatgctgataagaagaatgagtattctacagctgtaggatgaaatgttctgtaaatgtctgttaggtccacttgttctaaagcgcagtttaaaaccaatatctctttgttaattttttttccagatgatctgtctaatgatgcgagtgggatgttgttgttcccagcgattactgtactaaagtctatctctccctttagctccaattatatttgttttatatatctgggtgcaatgttgggtgcatatatacttagaattgttatatcatcttgccgaattgatccctttatcattatataatgaccttctttgtctctttttactgtttttgacttaaagtctgttttatctgatataagtattggtacctctgctcatttttggtttctgtttatgtggaataccttttccaacccttttactttcagtctatatgtctttatagataaggtgagattcctgtaagcagcatatagtttatgtttttcagatcctttcagctaatctatatcttctaagtgaaaagtttaatttgtttcaattcaagtttattattagcatgtgagggcttattcctgtcattttattaattgttttctggttgttttggatattctttgttcttttctttctgtgttattttttatcattgtagtttggaagtttctgtaggggtaacatttgagtcctttcccttccttatttgtgtgtttgttctaccaatcagttttacacattcatgtattttcataatggtaaatatcatcctttcactttcttgtgcaggactctttaaacatttcttataggaccagcctagtggttatgaattccctcaggttttacttgtctgagaagtatttcacttatctttcacttatgatggctaagtttactgtgtttagtaaatttgcctggcagttttttttttgtctgcactttcaatgtgtcatttcactccctcctggcctgtaaggttttgttgataaatttgttgctagtttgatgagaattcccttataaacgactagatgcttttcttttgctgattttaaaatgatctgtctttggcttttaatatcttgactataatgtacatgtagaagaactttacgggttgtgtctatttgaggatcttgagttttctgtatctggaggtctaaatctcttgctagagttggaagattttcagcttttcagctattatatcactaaataagttttctcttcctttgctcttctctttgccttctgggccccttaaacttcaaatattttgttgctttatggtgttccatatgtcacatatgatttgttcatgctttttaattctttttttctttatttttgtctgactgtgttattttaaaagacctgtctttaagttctgaaattctcctgcttcatcctagtaaattgttgaagatcacaaatttaactttttatttcattaatcagttatttagttcaatgatttctgtttggttctttttaatatctatttggtaaatttctcatttgtgtcctgaattgttttctagttctttgtattatttgtatttgttcttttttttatctcactcaggttctttaatatcattgtattgaatttttcccaggatttcatatttttattggaatctgttgttggagaatgattatgtttctttggagttgtgatatttccttgttttctcatgtttcatatagttacagtccatctgctgtaacagttctttcttctagttttttagacttgcttttgtagggtaagactttttcctgaagatgtatatatggtgttgcctgagtagggcaattttgctttggttataggtgcatgcagtagtgtagtctttgtgtagttttattttgtacaaatagcatcagtggtgtctttgatttcctcagtggcttagagtgcagttattagaggaggctatggtgaagttttcctggtgattaggacaccaggtgagtccgtcctcaggccccagtggtgggccaagcatgccttttcttgggtcctccatggcatacactggcaccagtgttagtggatccaggcaggccagttcttgggcctcccaagcagcttgctcaagggaaaacaatggcagtaatgtgctggttgggtgagcagctcattgatcccctaggcagtaggcatggcataggcaatggtagcactagtgatggtacacttctctgaagtggttcacactggtgtcattggtggctgagacaggctgggtgggccagtctccaggcccacaggtggcatatgtgggtggttgtcagctgtgaggtagtaactggctggttgggtccattctcaggcccctgggatgagtatttatgtgccaatgatggtgccaggggtgaggtgatcctcaggcctccagtagtgggctcaggtggaggctgcagtattagtgatgggtgaggggagcctgccttcaattttcatgcaagtattctgcagccctgctgctggggaggacagggctgctgtcagtggaagcagccataaactgatgactgtgaagcatgccattcagccccagacagcagctgtgcatgggggaacctgtcctcagagtacatgtaaatgaacagttgccccacttctggggacaatgaggtcattgtcaatggttcatattttaataccagcagcagcagaggtagaggtggcagtgggcagggtagccttgccttaaggcatgtgcaaatgcaagatgacctcattttatggggtcagcggggtcactggcagtagctcaggcttcagcccttgtggcagcatccggccatcacagtgactacaagtgggctatgcaaatagtgctccagaattgcggagataccggcattgctgggcctcatggcaggatttagtctagtgggtgctgggctctcaaaatggccctgttctatagctgcttaggacttgggagtgtgtaggacccagtgtgagcctcttttgtggaacagtgtgtttacacagtcaacaaggcaggtttctatgttagtctcagggcctgcaaaggtcgaggggctcttgcagggctaggattttgggagtctgtggtggggatgtagatgactagggatttctcacttactctttccccacactggaaatcctctcctcaagctaaagttttgagtgccagattaagtttagaatccaaagtaacagatgcaatgccaaatctggaaggaagtcggagaataatttgtgaaaaactaaacgaagattcagaaactggatgggagtagagagtgtaattcagatagaagagtgaaactatggatcattttgggtactttgagctcatgtatatattttgataaatatgtagtgtggtggtatatcagctggctgaaagaaaaatttcaagatagtcaaccaaagaacgaggggcaatgatgggctgggtggataagcaggtcatggatcataaagctctttttgctttatgttttattattttccctgggccccaagttatagtatttcccatgcatagctcatccttgtttaaaaaaagatttatacagacccaaacataaagaaagaatgagatgaatctgaggaaaataaacatattatatgtagaacatacatttgttatattacccatcaattgtactcctgagtttcataccacagtaatgattatccacacacaaacctgtgcatggttgttactattgagctaatttgcaatattcaaaaactagaaataacgacagtgtccctgaatgattgacaaatgatggtatattcatgccacagaatactactcagacataaaaataaattattgctatactcaacaactttagtgaataccaaggatattatactgaatgataaaagaacctcaagaggtcacatactgtattatttttctatataacattttataagtgatgaaactatagagatggaaagcaggtcagtggttgtcaaggattagccatggtggaaaagagaatggtggatgtgactgtaaaaagataggataaggtagattattgtggtgatggaatgttctgtgtctcgattgtggtggtgtttatacaaatctacatgtatgacaaaatgacatagaagtatatactcacattgtatcaagttgatttcctggttttgattttgtattatataagatgttaccattataggaaatgggtcgagggtacatggacctctctgtattattttcaaaacttcctggaattctaaaattatttccaaaaaaatttagaagtatttgtgacaaagagtgcctggattatgtaagagagtgcagagttttaatatggaaataattcatcagaggactaaaactatacatttaaggcaggatgattgtgtgtttctatagttactattttctaatatattgtattttagatgaattaccaatagcaaatcatacaaatagctggatctaaagagaatatataaagtcagaacaaataaatggtcagataccagagccatggtattctgaatccttcatgtagtaaaattaaccttttaagtgtgaataaattatcgattcacctctgaatgaggcaaagaaccacacaaagtaaacaccataatgttttcaagaccttatgcctgttcagtattagaatgactgttcatgaatggagagaaagtgaagtggtattatggataaagcaataaataacataaggtaaaataaaataagacaaaacaaaacaaggaaagcgagcactcaggaaagatgatgatgtattgtaaacatctggggtattatatatatcaagtaaactgtgaaactaaagtccaaaaggaaaaacaaagaccaaaaataaaacaaaaagcacttggcaaagacatgtaatcttttaatttttttctgaataaatttacgatgaagtaaaaaccagtatctttcagctgtatgaatacaaagatataagcatttctgtgagcactactttacatcttagggtcttccttaaagaaaataaaggaacaattacaggacagggcagcataatcaaacatttttttcctaagtaaatctgcagtttatttgtaaaataggcaaaaaaaaaaatcaggaagttgttagagtaaataaccatttttagtgctttttgtgttaatatgcaagggagggaaagcaaatggaaaacggacatatggaacagatttgttgaagcaggccccgttggcaaactcgattctattgctttgttcattgtctacattcaaatccaaacacattagtttctcctttatagtgactttgtttccatgacatcaaaacactattcagtttagggaaaaacaatctgtacagcaaggtgagagtcatgaagtttatacagtcaactccctgaatatataaatgtggatttgtgcatgtgtgaaaccttgactgatgtttcaaatttgaccttctaatcccggtaaaatttttatttgaatttggtgttttcaagaccaacaaagaatctcatcaataatttgtaacatttgtgaacacaaatttaattttttttagtctttgttaactgttagtttaaatctgcattcttttctgactaggtttaccatcaaaagcacaaatttgtaaagaatgtattcacttcttatgtatgttgatgacagaagattgaaaatcccaatgaatcaaaaccttttatgcttgtaggattacttcttgccatcattgtctttttttttccctgaagcagccaagaaaataaaagtgttctgcaatcaatttaccaataaatacccagaggtgactttgtagccaaaagatatccacaataatgttgcatctaggatttctcaaacactgagacacctgttaacgatttttaacaaaatattgtaaagattgagagttcatttcaacattatatgttgtaatgcatcgattagcagtgttagacagaaaaagtggatgttttggttacatatatattacaactctgaggaaacaattctatctaaagtttattttctgaaggagttaatattcactaattcaactccaatcttttccctggattaatttatcttctctccttcaatatatattacatttttgcctttctagtccacacccaactcatactcaacatatatatatatgtatgtacacaacaaatatatatatacacacacacctgatagtcatggatgatagattaatagagttgagtacttcacttaaaaaatagttgttaatgttgctgaatgtggattcatttcactgaacctaaccactgcatagtacatacacacatatgttattatattgatctatatgctaatttttctcagatatatttagattggattgatgtaatggattgtatgatgatgtttctcagtttattcagaataatctcagtttatgccaattatcctaggatagttatgaagtgtcacagtttgtatgataaattatagaatcattctagacacgggatgtgtgtatatttaatttagctaagcagtctctagattatatctaatactttatacttctttcggaacatgaggattcctgtttcaacacattctatcaagatttaccagtaactgactttcagatttctgcaactctgatggctataagaagtctctctttgcagttttaaattgcatgtttctctaattgctacggagatttggtggtactttaatttatttagttttagccttttaaggttttccacttgtgaattaactacttattgcctatgtgcattttatattggatgttctgtcttatattctaaatattaaccacttttcaattttcgatattataaataccattccttagcctgttatatatctgttaacattgtatataatgtcctttattgaataaaaatctgtaacttttgatgcattcaatcaaattaatcaatattttggcctaagttttctcctttgtggaatattattgaagaagtgtatccccattccaaaataacaaagtcatttttctgtaatttattttattattaagttgactgtttgtttactacatattaaaatatttaattatctaaagtgcactttggaataatagtaaaggattacctttattattttgtttacatattgatccaggttcccaaagccaactactaaatattacaacatttccatatccacttttggtggtccatttgtaatacattcattcctatgtacatatagcactgtgtttaaacttgtattccactccattgctctatttattctttagtgcaccaatgtcagattgtttcgttttgtgttttgctatgactctgtagattgttgtgaaatatatagcggagagcctctgttctttgaaacctcttatttattccatacatagtatttacatgcacctgattttcagatacattctataagatatttaagtgcattgaaactccagctgttagtgttagttagacacagaatggaagaagattgtggattggacaactttgctaatctctcttgttagagccaatagtttgcctattgatgctgttcaattttctgtgtggataattacatcatgtgagaatttaacagtttttttcctcgtttatttttcataattctgttccctatttcttccatcgaccaggatctacagttctatatcaaatagaataagtggcagcaggaaccatttttatgttttaaatctcaaactgattaggtctaaagattttaatgtccctttctttgttttaatataatttttaaatatatagatgggttttgtttaatgatagcttttgttgtggtaaattctcttttggtcatagttgtcatttaaggaattgaacattgaggtttttgttttcattaaggtaataagcatttatctatttgtttgaacattttaatcttatgttaaccttatctttttctgatgagtatcagtttctaagaaaaaaattaaaaatttcaaggaaaattattaatatatccgttctcttcatattttccctgttgttgctttacttaatttgagggcatgttattgtgtgcatatattcatgattactttctcatctctactgttttttttttttttttttttttttttttactatttttcaaataattctccgtttttataaaccttcccaacatttagttccactagtacccagcaatgccagtttggagaatagagatgtgtatgtcagattggttatcaggttcacccattgtaacaaaactaattgaatttccactcatccatctgctgctcacctttcaaaattttgttgccttttttaatcttctgtgctgttctctttgtttatatctttgaaaaaatttcctcatttttaatagaatgccaggagaatgaaaaattacatgcatttgtttaatgtattattttaccaggatgctcccattagtattttttcaaaaagttctacttgttaacttgctgtcatcattttttttcgctttcttggactttaaatatgatgatattaatgctcttaatcttatcctctagttatcttacatactctacttcccatttttatcctcttttatgccttctgagaggtatcctaaaactgttcttctatttcttaaagtgatttttatgtctgtcttgtctttcatttgggagacttttcactgttttttttattgctaattatcaccgataggttgttttattctcatccttctcttccaacttttattttaggttcaggggattacatgtgtatgtttgttacatggttaaattgcatgttgctggggtttggtgtacaaataatttcatcacccaggtagcgagcatagtacccaataggtagttttcaagtctcaccctcctctcactccaccttcaagtagaccctggcgtctgttgtttccttctttgggtctatgtgcactcagtgtttagcccccacttacaagtgagaacatgcagtatttgttttattgttcctgcattatttcacttaggataatggcctccagctgcatccatgttgctgcaaaggacatgatttcattggtttgtatggctgtgtagtactccatcatgtatatgtaccacattgtcattatccaatcaaccttgatgggtatctaggttgacttcatgtctttgctattattaatagtgctacaatgaacatactatatgtcatgtgtctatatggtagaacaatttatatttctttgggtatatacccagtgacgagattgctaatcaaatggtagttttttttttttaattccttgagaaattaccaaactgttttccacaatggtgaactaatttacattcccattagcagtgtataagcattcccttttctctgtatcctcaccagcatctgttattttttgactttttaataatagccattttgagtggtgtgagatggtacttattgtggttttgatttgcatttctttaattattagtgatgttatctttctttcatatgcttgtttgctgcatgtatgtcttcttttgagaagtgtttgttcatatactttgcccattttttattttacttatttatttattttgagacattgtctcactctgtcacgcaggctggagtgcagttgtgccatctcagctcactgcaaactttgcctcctgggctcaaggatctttccacttcaacctcctgaatagctgggactacaggtgtgtactaccacactcagctatgctgtgcccattgttaatggagttgtttgattttgcttgttaatttaagttccttatagattctggatataagaccttttcagatgcatagtttgcaaatatttcctcccattctgtaggttgtctgtttactctgttgattatttcttttgctgtgcagaagctctttaattaggtcccatttgtcaatttttatttttgttgcatttgcttttggagtctttctcatgaagcctttgccagggcctatgtccataactgtatttctttagtttccatctaggttttcttagttttagattttacatttaagtctttaattcatgttgacttgattttttgtatttggtgaaagaaaggtgtccagtttcaatcttctgcatatggctggccagttatcccagcaccatttattgcatagggaacactttcctcattgtttgttgttgttgactatttcaaagatcagatggtgatgtggtttggctctgtgtccccaccgaaatcttaccttgaattgtaatccccataatccccacatgtcaaaggtgggaccaggtggaggtaattgaagcttgaaggcagttttctccatgctgttcttgtgataatgagttagtctccccatatctgatggttgtataagtgtctggcatttcctctgcttgcactcatactctctcctgcctccctgtgaagaggtggcttccgtcatgattgtaagtttcctgaggcctgcccagccatgtgtgcaactgtgagtcaattaaacctcttctctttataagttattcagtcttgggcagttctttatggcagcatgaaaatgggccaatacaaatggttataggtgtttggctctatctctgggttctctgtttgattgctttggtctatgtgtctatttttgtactactaccatgctgttttgtttacagtagccctgtggtatagtttgaagtctggtaatgtggtgtttccagctttcttctttttgcttagggttgctttgctattcaggctcttttatggttgcatataaattttagcatagtttttctaattctgtgaaaaatgtaattgatagtttgataagaatagcattgaatctgtaaatttctttggagaatatggtcattttaacagtattgattcttcctatttgatcagttattttaattgttttctctctttcagctttcacatatacttccatgtcattttgaactcacttgttaaactcattttaactcttattatctctggtctgttgaatctggtatttccatttatttgttgtctttctttcatgatttctgggctccttacatgagcttcttctcgttccttttgtttgtttgtttgttttttcccatggacatatatattcttcgctattgctacttagtctggtaataagtagttgcagggaagttagatagtacaggccctaacctgaggccctcttggtgagtttaggggaaacaaaacattctcttctgggctattttttatgttttagattgcataatcacaaaaaaaatctggaaaaataattaaaaaaaagaacatgagtgctaatttatcttgtttcctgataatgattcctgtgacagcagatactctgcataggtcaatttctgtgaagagggagttattacatgaaggagtcttcggatagtatgcttttgaatatagcaatttttgtgagagtatctctctcctagtatctgccttttcttgagactttaaatgtgaaaggatgatttttcattgtttcaacaagttttgctgatttcctttttccttttctccatgatgatcagaggagtgcattctcattattgtaaactcggaaaacttggaatggttaaaaaaaaaacacaaaatgatttaaaagccataaccagtgatttgtaattgaataaaatactacactccatttaaaatgatgccaatacatttgaccatttcttcttggcattatatttcctcaaaatcacttttgtatatattaatataagatccataatttcaaagaaacatgtaacttatcaactaccttatctgtggaaatgtagtttgttttcaatttttgttattataaataatgttttgataaagtctttgtacataaatagcaatgctctcattttcttgggagacagtcttaaacatagaagtagtgttaaaatgtatgagttattttgtagatttttgttacaccaaaacaataaactttctttgcccatcaatgcaaattatagaaattgtgatcaaatatggcattttattttcaattaacctagatgtctactcagaattcttcccaacacagccactaatctactacaaataaaacatttaacaattatctttagtctgtattaggaattgaggatctaaattgagtttctacaaaatattccccgattttttatcatttattaacaaccacatttcacttaattttttgatagtgttaagattattcagtttttgtacatgtttagcagcatccctttttggaccctatattatgactgattgatttagctagggactcctgcacaagtgataccatgcttcaaatcattgagcttcacagtattttgtagtgttagttttaccatatgtttttactcttctctaaagtagtcttgactttacttgcttattttttgcaagtaaaatttagaaatatgttgataatctaaaaatggattccattgttacatttattagacatgatttaaatgtatacaataattttgaaagaaattctgtcatttccttgtgcatacttcctgctatggtttggatcatgatgcccttctaaaatttatacggaaattaatccccatttggtagtattaagaggtggtgccttatggggaagtgatttattcatgaggactctaccttcgtaaatgagattaccactcttataaaagagcttgagattgaaaggagcactcttttgccctttccacccttttcaccatgtgagaacacagcatttctcccttttggaggatgtagcgacaaagcactcttatggaatcagagagcctcactgcatacacaatctgctggtaccttgatcttgcacttcccagccttcagaactgcaagaaataacttttttctttataaattactcagtctcaagcaagtattctcttatagcagcacaaatggtctgacacaatttccatccaagagtatattttctctctttattccacttttgtgtgctcagataattttgttacctcaatacatttttacagttttatgcacgcaagatatgtgtatttcttttcagaagcagcataattctgctctgctttgttggtgtaataaaatagttatctattacattttctaaatggataacttgcatatgttaaaactttcaatttggtatatttattaaacaccatcaaataatggttcaagaagttctataaagcccaggtgagataagtaaaaacaaatcccagcatacagtatatattaatctgttttcatgctgctgataaagaaccaagactgggcaatttacaaaagaaaaagattcaatggacttacagttccacatggctggggaggcctcacaatcatggcagaaggcaaggaggagcaaatcacgtcttacatggatggcagcaggcaaagagagagagaacttgtgcagagaaactctcattttttaaagccattagatcttgtgagacttattcactatcacaagaacagcacaagaaagacttgcccccatgattcaattacctcccactgggtccatcccgtaacacatgggaatccaagatgagatctgggtggggaacatagccaaactatatcatagtacataataaaaaattgctacaaatagaaaaaaagagaaaatactaatttcagagaaaagagacgtgttaccttcaatgatgcaacaaatagaatcctaattgtcttcccaataaaaactatagaaaccagaacacagtgagattgtatacaagttgcttcaacttactgaaatatttttttttaatttccataggttactggggaacaggtggtgtttggttacatgagtaagttctttagtggtgatttgtcagattttcgtgcacccattacccaagcagtatacactgcatccaatttgtagtattttatccctcacccccttcccctgagtccccaaagtccactgtgtcattcttatgcctttgcatcctcatagcttaactcccacttatgaatgagaacatatgatgtttggttttccattcctgagttactttacttagaataaaagtctctaatttcatcaaggttgctgtgaatgtcattaattaatttatttttatgactgtgtaatattccatcatatatatatatatatataccatggtttctttatccgcttattgatagatgggcattttggttggttccacagttttgcaattgcgatttgtgctgctataaagatgtgtgtgcaagtatctttttgtataatgacttcttttcctctggtagatacccagtagtgggattgctggattaaatggtagttctacttttattttcttaagaaatctccgcagtaggttgcagtgagccaagattacaccattgtactccagtctgggtgacagagggagactccgtctcaaaataaaataaaataaaataaaataaaataaaataaaataatctccaccttgttttccatagtggttgtactactagtttacatcattcccaccagcagtgtagaaatgttcccttttttgtgtttgtttgttttctttttcttttcttttcttttcttttttttttttttttttttttttttgagatggagtctcactctgtcacccaggctggagtgcagtggtgtgatttccactcactgcaaccttcgcctcccaggttcaagcaattctccagactcagcctcctgagtagctgggattacaggcacctgccaccacgcccggctaatttttgcatttttagtagagatgggatttcaccatcttggccaggctgatcttgaactcctgacctcgtgatccacctgcctctgcctgcctcccaaagtgctgggatttcaggtgtgagccaccacacccagcctgttccctggtttttatatgatgtctacagggtttagctgcacataccaagagggatagggaaaaaattgtctattctatcttttctgaaactgaaagatcctaaacctttcttttaacttctagaatttattttttcattttgctcagaaaatgagacttgtagcatgtctgtttgtagtatagtgaaatttgttattgagtaatttatcaacatttttccaaatcctattagtacttccattacacattttttttttttttgagatggagtctcactctgtcacccaggctggagtgcagtgtcacagtctcagctcactgcaacctctgcctcctgggttcaagcaattctcctttctcaacctcttgagtagctgggactaaaggcatgtgccaccatgcccagctaatctttgtatttttagtagagatggggttttgccatgttggccaagctagtcttgagctcctgacctcaagtgatctgcccgcctcggcctcccaaagtgctgggattacgggcgtgagccaccccgcctggccccattacacatttttaattatcatttccatttgttatgatatattttagtgagctttgcagtttgtctttttatttcttgactttacataatttttgtcatttatctcgatatttctgaagacattttctttaattacttattattatagaaataattcacaaatgtatttcttgcttaaacaatatagacaatatggagatatgtacatcaaaatagaaatgtctaccttcacaatacaactagaaataaaaatatatggaatttcatggaagggctttatgttgtttaaacttggatatatactacttgttttccagaggtataggctaccatcaccactatacctaccagaaacacgtggactggagaagtgctttcaccaagattgaggtgttaatagacaaaagtccagctacttgaacaacagagtatttttgtaaaattgattgcttgaagtaaaaatgctgcaagtgattttcacattccaaacttacagactctgtcagttcaccttcctcaaacgctttatccatttacatttctatccaaaatataaagagcatattcttctctatatctttgcaaacaccacacatgtttagtcttttaaaattgtgtgaatctattgcataaaattgtcatggctttgttgcttaccctttcatttttctgactacaagttatattcaagtaggtttgtgaaagttatgcatttctatttctgtagtcttttatttttcctatttctgtgtttatacttacaatgattattttatagagaatttcttcttgaggaaaatgcaaaccagatgttttttaaattcagtccattcactttagaaaagtgtttttagatatttactcttcatctaaatctctatagaaaaatctctcttttctatatattttgttaatttttcccttacattgctcatccttgtataaggtaggattaatacagatacacagatctaaattgtactttgcttatagaatcttacttccaggtcaaaacctagccctgagtttccaatattgagtggatttgcaactaaagctgttctgataaattatgatgggcttgtttcttcttccagatagttaattcactaactctttgagagatagaatatatacaaattaacatttattggatgcattttaattagaaatttctatattttctcttgtctccaaggcttgacttatgggaactgtttctcctagggtacaatgcatgattatgaatacttcttcctctacttgttttttgtagttacacacgcacacaaaagttcacatgtattcctttttctaattaacctactttctgccaggaaggtcatattttggtgatgctttgctagacttctcttgaatattgttattcctcctacaatatgactgctatattcttaaaataatgtgctaaggatataatcaagatatatggcaccatgtttgtgtaccttccacatataaatatattctcatatatactcaatataaatatattcttagcacgtatctatacagacgcaagtgtggtcattgtagaagaaatgagagacataggaccatggaagcataattcagcctcctcactattgtcctaagtaattctttgcagtctccaaattttcgtagttcactcgtctaaacaaaagcccagtaatcaagtgaaatcagttttccctaaaatcaatttatgaactgtcaacttttccttgcacttacagcttgaagagggtttactttttttcaacctctatcctaaatgtcctatcaataatatattcagcctgatggatggccagtgtcaaagaaaactaaagctggacagtagttaatgtggtaaaaacagactgttttcaggcctatagcaataggagaaaagagaccacagtatagaactgggctcaattccaaatatagcatgggcaagtgagaatttatagccaaggagcagagtagaagttgatggatggaaagttactaggaggaaacatcgggagtgggactgtattctggctaaaggaatctaacaggattcttgtgaagacagtccagggtgatcagatacctcctggggaatggtgcaagaggagggacctaatcagatattgaggatgaagattcttgctaaactaacttagcaagtttcttgcaaaatctagattttacaatgaaatgcacagataggcctaggagaaggtttagaagcctgactaaagtttgatcaagcaaagaatctttgtcatcccattaattaaatattctccatattcttacattttcaacaatattttagtgatactaaagtgctgtcatcacagaaacctacccacaggtatctttttattccttagtaaacatctgcataacaggcaatgaaaaattgaggtctgccaggaggatgacttagtacatacaatattagcaatcagttagcctaaccaatgatttgctaaaaagcaatagaaaatatatttccaaataaaattgtagtgaaatttttatatgcaatgcagataacaaaagaagccattccctcttataacttgggatgggggaaggtcaggcattggctatgccgaccttacttattaacttttttctcccttcttactcaagaccatttaaatactgtatttcaatttaggtaactgtattcaattcaaagtattttttaacattttcatttcataatagaattttagctgtcctccctattgtcagttcctcccttttgcatctaccctgtaaagtctcagagactaaacttcccaaggcacagttcttggcccgtttacctaatccttcagtggctccatatcatctataaacttgaatacaaaatcctcaatatctcattcaaggctttcaaaaagtaaatttccaaattctcagtcaggttgactccctttgtttggtgaaagtctccctgtatttctctttgtccatatttttgttcctgctataccttctttttaattataattttatttcagatacagaggatacatgttcatgtttgttacatgggcatattgtgtgatggtttggagtacgtatactgtcacccaggtagtgagcatacaacccaatggatagtttatcaacccacaccccctctctccctcactgctctagtagttctcagtgtctattgttctcaagtctctgctcatatgtgttcaatatttagcttccagttataagtgaaagcattcagtatctagttttctgtttttatattaattcacttaagattatggtctccagctgtatccatgttgctgcaaagaacgacttcttcatttgtttttatttatatgaacagacgtttctcaaaaaaaggcatacaaatggcaaaaagaaaagaaaaagtgctcagtgtcactaataatcagaaaatacaaaacaaaaccaaaatgaaataccatctcacaccatttagaatgactattattaaaaagtcaaaaaataatagatgccggcgaggctatggagaaaagggaacgattatcctctgttggtgggagtataaattaattcaaccatttattgtgtgatgctgaggtttggagtatagattctgtcacccaggtagtgagcagacatcgtggaagacagtgtggcaatttcttaaagagctaaaaacagaactacaattcaacacagcatcctattaccgggtatatatccaaatgaatgtcgttctatcaaaaagacacatgcactcacatattcattgccatgctattcaaaacagcaaggacattgaatcaacctaggttcccatcaatggtagactaaagaaaatgtggtacatatacaccatgggataccctgctgtatatttctgattgggatgcaattcttactgacctacctcatgatgtactttgaaggcatacattaaatgatatggactctctgaaatatttccttttttccctaaatttggacatagtgtcttcttcaagttccctctagtcgatgcctactgcttttcctctccatgtttccttctcctactgagagaactcccacttatcatgagaagccatttttctcactctgattctacacagcttgacaattgattcccagacctgataaatcagagcatgatataatcctgatcatagcaattatgtcttatttgggtacatgagtgaatttatgttaataagattaaattcggggacaaggattagaaaagatattcaatctttctgttcaggtttctgagggaatgaaatattagccggatcctgctagcagtcatgttgtcaccctgagaaagtagaaagtctgagatgtaagcaaagagaaccagcacagaggaaagcagatcctggggctagagaacatgagaacaagtagtgatgatataatctgggctttagtcatttctaaagtcagcagtatctctaaatgttcaggtttgtacatcattaagctttgccttttgcttaatccattttggttgattttctgtcagtagcaaatgatagagtattcaatgactttctcatacggcactttatttgtgtttgtttcttggaattgtaattgaatttgaataagcattatggctaaatttgcatgtatttcctctttcatcccctcatgtttctaccctcccattttagcctcccacaacctatgtaacttcttaaaggacattattcatattttccctatcaattatttcaaacatcctaaaacattgtagacaattgatgcctgattttaaaagaaattgtagctagtccatgtgtctctttgcatgtgaatacagactaaaatagcaatgctactcctcagtaaagtgggtgtttttttagaataaaagacatattgaatccatgaggcccattttctggtgattttccctgcagagaagaaaaatcattatttttgtgaccatgaaaattcattatttttaattttttagtcttcaacttttaggttcaggggttatatgtacaggtttgttacatgggtaaattgcatgttactgaggtttggtgtacgaataatcctgtcactcaggtaatgagcatagtacccaataggtattttgtcagtccttgccccattcccactatctcccaactagtagtccccaatgtctgttgtgcccttctatatgtccatgtgtactcttctttagctcccacttataagttagaacgtgcagtatttggttttctgtttctgcgttaatttgcttaggataatggcctccagctgcatccatgtttctgcaagggacatgatttctttttagagttttcaagacttttcagcacattgacatcaaatagattcaacttcaaaactataacctggtagaaaatttcccctatcctttagaagtaatcctaaacattcacttatgatggattaacagtggtgtgtgctccatacatattgaaggaaaacaaaattaaagtcaactatctctttgtgcttctgccctagagaattatggagttgatgtttatttcaaaataatcatagattaaacaaggaattgaagtatttgggtcaacaaagaaataaaccacttttcctcctggaggaaacaggaaaaccataaacattttcctgttagatgtgtcataagagaattaatcatactttctctatttctatttctactgtctgaaacatcaaaagcaataaggaaatgatttaatacgatggttcttcaaaaaaaatgaaattcttatttttttagtgaaagttgaatctggccatgttacttcatttgtgaaaactttggaacattgataaactaacactctgtagtttatggcagtataatgatactaccagctataattattttaaaatacagacctctggatgcctgtgatccttgctgttaataaatagtgtaaatacttcatatctttgtacatcttgagaaaagaagaatgtcatttttaattcctttattatgatatttggagtagattccattcaaatatactaaatacgacaatggaatgaaagcaaaacaaaatggtcagcaaaagtaagaattggcattttattccctctagtctttgctttttgtaaattccacatttcacaaggcatgtgatttttcttttagtcagcaggggactatcaaggagttagccaaccagaaagtgtctatgaaaataacaagagggaattatctaccttgtagaccacagggaagtaatgtttttaaagctaggtcaagaattaggcaaagaaacctttacatttacaatacagttgtaataactttgagctttatgatagctgtaatattgcacttatgctacatctgctattttattttaaattcctgagcccttacatgaaaactcaagctaaaatcctataatgaagagccgactagacattcaagttattttctttatttaaattcattgggatagtaacattaatatccattctaaagctagaatacatcagttgaaactattgcttaatgtaaatcaattgaaactaatagaaataaagtatcaacatgttgccggtgtgtgggggggatgcttgtcatacaagattccccaatattacggattgatacattatttagaaaatttgttaaattttttttttgaaatgatagttgaatgaagaagggaggaaagagccatgttattctttgaaaattagctctggggaactggggaagtaaacttatgagggtttcaattgggaatcatttatagtacagtatattacaccaaccaatagcttaattaaaatatgtatctaggacagtaacattgatccaaaggactttcatatttcattttctgtaaaataaccacacaaagaatatttgttacctaaggccaagtttctagagtctaaaactacagaaaaacttgtaacaaacaataatcgcttggtaaattgattttagtttagagtacttcacaggacaagacaggtattacagtttctgtacaggaacccttggccttagaaatgagcctgcttggggagtatctgagtacttttatttacctaatgtgggatctctatatgttagaactttctcagccaaacccagaaattttaattgccatttgttttgagagcttctcatttcatagtaatgaaactcatgttttctatcagtgaaaaaacaaaagaaccattttaaaattcagcattaaggaattctgtaggagtttatgataggaatgtaaaatataatcacattttgtaactctggataatgtgtgatattttattcacattcatatgtactcctgcatacacatacattgaacataattgtgtgttaatatagactgtatatataatgtgtaatatgtattacattcagtatacttataaattaaacttgcgtgccatagacataagtatgatgaaccagtatgtaagctaataagtttcttttcattgctttttaatttccctcttaaaatttcacatatacttactatttaacgtatatctgtgggagattccctaatttagagaaatgttagatagcacctagaaagactggtgtgtgaaaatagttacttgaaattttctccaatatttctgataataaagccactccaaattttctcatattcttataatgacaaagcaatttttgtgaatgtaggattttgttatggactaaaccataattttaaaagttttctttcaggacaaaacattctcactactttttttatgagaagagtgttacaaaatttaaaattaaagaaaaatagtctgatgtgtgtttatcacctgttaggaagtagtgtagatctataaaggtggttgcagcccttgaaagcaacaaatattagattttataattatgccaaaaaaataaaaaatgtgtctgtacataacctataagatattacgatcacttaatttagaaaatattgtatggaaggagtaaaagagtaaaaatatctgaaaattgtgttttaaaccaaggaatttatctgtaaaggaaggagaatccatcaaatccaagaacattttgaatatttaatttttttttctgcaaaagccctccacaaaccacagaatgccataaactgtgtttgaacaacttgaaggacagatgtgacaaattctgctagatcattcaacttcagtttcaggtattgccaatagaaagttctttcttatactaaaacaaaatcagtccactaacagtttctgctcagtgttttcaatttcaacttttatagacattgttctgtttcaagtccctacataggtggctcactttgacatgtgcccaggttctgcatttacttctaaaattattgcacacaatttcagctctgggagtgactgggttgatgagaaaaaataatcaactttcgtgttgtcaatttgtaccaatacagaatataatgtacctaataatattgtagccatatcatatctgcttcatatttagctaaacaaaattctgatggaaaaagaaaatatccttattatttttaaataaaataaaatagttaaaataagatttgaaattaggtgtttgatttgttgaattactgggagaaccaaaggatagccagttgcagatttaaaaaaatcatgctttaaaaaaggcttgggaggccaaggcgggtggatcacgaggtcagaagttcaagaccagcctggccaagatgatgaaaccccatctctactaaagatacagaaattagcagggcgtggtggcaggtgcctgtaatcccagctacttgggaggctgaggcagagaattgcttgaacctgggaggcggaggttgcagtgagccgagatagcaccactgcacttcatcctgggcaacagagtgagactctgtcccccccaaaaaatcttaaattataatttttataagtattttgcaaggctaatttgttgatatgaaagaattctgacacattgcaaaggaaatggcacaactacaaaatagaaatggcagtgtaatgtgttatcacatttagtatcatagttaaatataatattacattttaattaagttaaaaatcatttaaaacgattggcaaattaatttgataaaaatggcagcatttataatcctgcagtaaagcacattctttttttttttttttttaacataaagaggctcctaaaaatcatctatttagttagatcaatttagagattttaaaacaaactgattttattagctgctgatgcttaccaaaataaaatctgctgatatacaggttgtgtaatttctctttttgatattttgaattctgtttcattttgtctgcagtgattttgtattaacatatgtattttcttcagtttttaaattccatggctgtcttaatctgtaagattgtttatcaatatataaaattgtttgcctacaaataggtctaagagggtaaaagataatctatattgagaatggccagaaatgaaaagacttttgaggtatcatagaaggtctggaacagaaacaaaataaagtcacagaacattcttcctgaaagaaaaactcaagaatatcttcagagattcctattttagtcaaggatattgacacacagagaagaacatgattaaagaaagctactatctaaaatgttttaggaaactctaataagttttgtctaggaaattacaactggatatgcatatatacacacacaaaatgcatattatgtatatataatgaaagcatatgtatacacacatacatgtacatgcatagcaattacaaatggatatatatacacacacacatacatataaatatgacatgcattagattatttttaaggtgtactatatttgttgttatttaaaggtctccttaaattttagctgtaaaacaaatatagctacatttttaaagtttttaaatttttagtttgtgtgggtacatagtaggtgtatgtattattggatatgagatgttttgatacaggcatgcaatgtatgagactcacatcatagagaatggggatccatccccttaagcattcactcgttgttttacacacaacccaattatactcttagttatttaaaaatgtacaattaagttataatcggctatattcaccctgttgtatataaaataataggtcttattcattcttggtatttttttgtatctattaaccatccccatctctcccctctctgcagcccccaactacccttcccagcctctggtaagcatcctatcctatatgcccacgagttaaattgtttcgatttttagatccccaaataagtgagaacatgagatgtttgtctttctgtgtctggcttatttcacttaacgtaatgatctccagttccatccctgttgttgcaaattactggatctcattgttctttatggctgaatagtacattgtgcatatgtaaaacattttctttatctattcatctgttgatgcacacttaggtttcttggctgctgtgaacagtgctgcaagaaacaagggagtgcagatagctctttgatatattgatttcctttcttttgggcatatatccagccatgggattgctagatcatttggtggctctatttttagatatttgtgtaagctccaaactgttctctatagtgattgtactaatttacattcccaccaacagtttaggaaggttccctttctccacattggcgcgagaatttgttattgcctgtcttttggggaaaaaagccagtttaactgggatgagaagatatctcattgtagtttggatttgcatttctctgatgatcagtgatgttgagtactttttcatatgcctgtttgccatttgtatgtcttcttttgggaaatgtttgttcaaatatttttcccattttttgatgggattatttgattttttcctaagcctaggaatgccttaggattgtactcttcctcctccagcacacggaagccctctctgtaccatgccacagctgcaggcgagtgagtgaagggtggtgtccacaattcacgacttgtttttcctatctcttcagtgcctttttcaatgatacaaagttagaagcaggtactatgagcgctaacttgactttttattcttatgaaggagatatttttctgtgtgtagttagttgttaagctggtgtccttgctagttggaattggtggagccttcttttccaccatcttgttccacgcccctcctatatctacattttttaaaaatcttaaacttatagctaatgtttaacctatagaacctggcattagaaaagctagcttgtagacagacaccgtctaacatgctcaacagaattttctactaagtacacactaggatggctttaataaaatgactgaaatatgactgacaccaccaaatgttgtcaaggatttagtgcaaactgaactcttatatattgttggttggagtataaaatttgaaaatcagttccacggtttgtcataaggttaaacatacacctggtatatgatcaagcaattctactcctatatatttagtcaagagaaatgaaagaacatgtacagaaaaagacatgtttaagaatcttcagagctactttattttcaagagctatattgtcttttttaaacaaaggcctgataggtttcttaaaaaaccatcgcttgtcactttaataagaggagtaataatagtttacatctttatttttttattgcccatgagattataattatctctttttttcataatagtgcgtctaatgaaatcaaggttccttagcacttattatataaagaaataaagaatttttgtatgactaatcaacatttatttctgtcttattacatgacgactatctccctggaaacttgtagctatattgatgcctaagttaattatcagtaacatagaaaatgtgcaaagaaaaaacccaggagaaaaaaatcagaaaatatgaataatctaataaaattttaagagtcatacaagtatagttgtatgcctttatttatcaataaaaactaattatttaggagtaagttatattgtataggtttctttgacaggtgcatttagttttcaaaatagaattatttttgttttaattttcactttgagtagttttaatgtaaagtgtgataaatattccctcatagcacaagttctagctggctctcattatgacacctaaattggataaattattcttgcttttctggatagaagtcataattgtaaactgcttacaatttgcatttatattccaagatactaggaaagtatcaggcactgccttatcagattttatgacacactcgggtctaaggtagtctagaaagcagcaatcatgtattggattcagaactgattgaaagctggacaaagtttagttggattgtaaaaaaatgcatactgtattattaataggcatttgagaatgcatttaaattggggagcaaaaaatgtctttacagattaaggcagattatctgttgtcaaaatcaacatatgagtccagatgttaataataaaatactttactcaggaggactattgcaatagggagatgttcaaagcctaggccataaaagtctcaagtaaagggtacatgagcacagcttttatatacagagaccatgagtgcggaaagaagggtatgctgccaaaactgctaggatgatgccttgaaatttaacaaactgtatcaaatattgtaataaggggaaggttgaggtgcatgggagggagtttgggcctgaaatggagcaactaatatacagtgcaaaaagttcatgtaaaaagtttacggtcaactgcctttgtcaagccagcttgaatttatgtgaaacacagcctttgatcagccttgtaaattccttttcatgtttaagaaaggctcagagacattgtttttgaaaaactcagggattagggaaatcctaagtagggaatgactgagtgaaatattcatcatagtcagatttttcttggtgatatcattcctgaaggagcagttgtaccctctgttggacatgcagtttgattgatagttattgggagattctattgatgaagcatttggtcaaggaaattcctataataataaatagaaggagaaaaattagaggatgaatgagagagtaaaatcagtactttagtttaggaggcaactgtcaaatggattccaagatatgggtgcagaagactctcttattggtggtatgaggatgactatgttgatgtaataaattttcctttgtgaaacccttccataatggaagtggtccaatgtaattatcctgccacattggctggctgactaacccagggaatggtccactatgggagaatcagtgttgatctctgttggtagcagattgggcaccgagcagtggctgtagccatttcagccttgacgagtagaaatccacattttcaaagtccatgaataacctctgtccctgagatcatggacacttagttcatatgcccattgggtgatgacgggagtgatctgggaaggaggctggctggtatccacaaatgtgttattcaatccacttaattattgatatcttcttctgatgaggttggtctttggtcagtattcatgtgggacacaaatatctttatggtttttgctccttcagaaagttctatctgcatacatcttccccaaatttccctgtcaccggttttccaatcaagttcctttcaagttcctgactgtccagcaaaccattggccacaacccatgaaatggtacataatcacatttctccttccaagcaaagtgaacaaccagtggatgctcaaagttttgcccactgggagaaattttttttcaccactgtccttcagggatgtcccagaaagagactgtagtgctgctactatccacttttgaatggtacctgcatatcatgcagaatcatctgtaaaccaggtccaagcctttgcttcttctgtcaactgatcataggaaactccccatgaggccatagatgcaggctgggaaataggaggtagtgtattatgagtggagaccatgggcatttgtaccacttcatgcaacctgtgctttcagggccagtttgggctcaatcttctatataccacattcagttcgtgatagagcactactgtgcacactcaacttcatggtttgatagatcagataatacccagttcatgatgtttacctcaggtcacgaggtaacttggtcacccatggctaagtgttcagtctctgctaaggcccagtagcaagcaaaaagctgatttttaaaaggaggttagttacatacagaggatttcagggccttccttcaaaatactaagggtctgaactgtgattcacctatgcaggtctgcctaaaggtacaaacagcattcctataggctactaacaattcaaacaccattggatctgctgaatcatagggcacaattggcagagcagcttgcagagaaacctggacctgttacagagcctctgtcattctgagattccttcaaaactaacagctttttgagtcagtaaatgggctagagtaacacacccaaatgaggagtatcatgcctctagaatccaaagaggttcaatggacttcatggctcttttttggtggtagaaagggctagatacaacaacttatccttcaccttagaagggatatttctacatgccttacaccactggacccctagacatttcactgaggtgaaagaccccagaattttgtcagatttgcttcctacggtctgacacacaaatatcttcccaatcagtctacagtggctgctacttagttcttattacttccagtcagcatagtgtcatcaatgtaaaggactagtgtggtatcttgtggaaggaaaagtttatctcaatttttatacgacctgtcagccagaagggacaacataaatttacttttatcagaacctgtagagtttgtaattgtgggtaattgactgcttgctaagagctggaagcacagataaaggagtacaaggcctcgagagtacattcaccaaggccttttaagaaagtaacaaaggggactgaataccttaagctctctctcttccatcttctgatcttttgccactgcaatctcaaaaagaaatacaatggcaaaggaacctagataatagaattcacacaactcaacttcaaagggaatatagtagagtagagaaagatgaactcaaaggtctaaatggagacaagctagcgtttttaaaatggtatcttgctttctgtagttgtttctttgttttagcaaactaagtgaatgtctacagaggtgtttatgcaaaatctctaaatacaaatgtaccatagcttagaagttattagagttgttgcatttgtcagaattgtggatattcaaatattcctgaaactgagaaggggttgtggcagacatccaagaggctaaagtgggacctcattagtctttggacgaaaagggactcctgggcccatctaatatgtgccctttaaatccttagtatacatatatactatgtaatttaatattctgttttaaattcctcatgtatacagagataggtacacaataaaagataaatataagggtgcgtatataagaatgtgtgcatgcagtactaaaatttatcttgccattcttgcttgcgtttctaaatcatcatttgtagttctacttctccagaaacgttctctcaaattcctgaaatattgttatggctaattaagtaggtaactcaattttttgttaatatcataaagaaattaagtaatagtgaagaagaatagaaaaaatggcatattttattaagttggaagcacttaaaaataattctgaaataatatatgacagtatgtgaagataaattaacaatgcctttttgtgctgcaatattttatggaaatctttataagtacatacatacttttcttgcatatgtaatgtgcttccaattcccatttgtagttctgatatgatattatggtgcatactggtaaagctattgttttacccgactctttgttgttgttgttatcgttttcaactttgttggggatagatttttcgaaagcataaatagaaaaatttctagtgagaggcttgtccttcagagacttcatgtgtttccctatttttatgaacgtattagtggcagcaaataacaataatgttactatgcagttcatttcctcttagccacattcccatgacaacagctaagtaattcacatttcagaaaaaaaatttagaaagataaaaggagcataattacctagaattttctgatcccatgaaagacagaaacctaataataagacgttactgaaaaataagaatctgtctcctactatttcatttctataataacttatgcattgccttattaataaacgttagtgttgagtgattcttttgaagaaatgtccacattttccattaatttaaacagttgcattttcttatcatatctgattgctaccaacattactgaatttcttaaattcatccctatataaacaaattcagataaatacactgcaaatttaacaatttcaatttttaaacacattgaaatttgttgcaatgcataagtgtttaaatctgactaaattcagttatagtacaatacaaaaactatgggaaaccaaacagcagaggtttcttatcactatttaaaagttgatagacattcatgaagcattaatttgggtctaatagtgttttatataatgaagacacaaaaaataaagcacactttctcccaaagacaaacagtttagagaatccatgagaaaagtttaataccatgtgacagttactcaattagtattatattcaaaaaactagaaaaacatgtaggaaagacttttctgtctgaaattatcaagtgttaactacagatagatcatgctattgaagtaaggttttcagaaagaaaactggagaatgacgttataggaagaggatacagtataaaccaagcttggagccataaaattagttctagttttcaggaaggagggaatagttcaatgtatttaacatatggggtataattgaggtggtgactaccaatacaatctgcaatcaagttttgaaagaacatgtaggattttttttagtctatcctgtgcaaaataaattttattttgaagaatgcatgacttcatgcgtggtgtttttcctaggttagaggcattgacttgattgtatgagtggatttgagcatggaagagtttagactggattaagaaaatgtggcacatacacaccatggaatactatgcagccataaaaaaaggatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaacatcacactctggggactgttgtggggtgggggggaggggggagggatagcagtgggagatatacctaatgctagatgacgagttagtgggtgcagcacaccagcatggcacatgtatacatatgtaactaacctgcacaatgtgcacatgtaccctaaaactaaaagtataataataaaaaataaaaaataaaaaaaagaatatttagaatagaaatagagatttaaaaaatcgtacatgagcccagatggaagccataggagaaattcagaagtccaaaatgaaaacaaggtaggcatatagtacaactgagctatagttaacttaaaatgtataccaccataacttttatcatcctccaacttgagtaaacaatgttcacaaagacataagatgtcactaaacccagagaagccagaagataatatgaggatgtgagggccagttaatctgtgtatacatgagccacatgaagcccatcctgtcccatatacttatttacacacccccttggagagaagcagaggctacagtagaaattaccagaaaatatgagctttacttaaaagagtaattgatgtctctattaacataaggtgtcctgtttactctatgagttcttaaacttttctctgtctttagattccagcagttcaactctcatatggcttgatgtgaccttttcattattcctgcttaggtgtaacagtacttgttgaatcaatggatttgatggcattttcagttttgcagtattgtgttcctcttatagatatttttctgctctactttccagtttatgtattttctattaccaagtacagtagttcttctttatctatggaagatacatttcaagaccctgagtggatgtctgaaactgcagatagtttcaaagcctatatatttttttgatctgataactgataaggctactaagtgactaacaggcaggtagcttatataatgtacatacaatggacaaagaaattattcgtatcctaggtgggatggcaagagattttatcatgttcctcagaatgacatgtgattcaaatattataagttgtttattttttgaattttgaatttaatattatcacattgtggtggatggtgggtaatggaaactaaagaaggcaaaaccactgataaggggggttctactgtatctcttcaattactccttctggtctatcttctttctcatcgcctcttggaatccaattaattataaaatagaacatttcattgctccctgtgccttttaaaaatatttccaacccctttctctctgttcctctacagatactttcctctgctctatcttccagtttattaatcctctattcaacatttcctaatctgctattaaaccatattgaaggtcttgattttaattattattttgtagttcataacatccttcggatcttatagtgtagagtcattttcttccttgtcttttaaattcctgaccacttaagtcatagctatcttaaattttcagtcagaagaagacaggtgattattaaaaagtcaaaaaacagcaaatactggcaaggctgtggagaaaagggaacacttacatactgttgatggggatgtaaattagttcagccactgtggaaagcagtctggacatttctcgaagaacttaaaacagagctaccatttgatccagcaatccaagtactgggtatatacccaaaagaaaataaattattctccaaaagaaacccacataaactcacatgttcatcaatacactattcacaatagcaaagccatgatatcaacccaggtgcttatcaatggtagactgaataaagaacatgtggtacatatatacgatggaatacaatgcagctattaaaagtgaaatcatatcttttgcagcaacatggatgaaactgcaggccataatcttaagcaaattaatgcaaaaacagaagatcaaataatgcattttgtcacttataagtgggagctagatattgagcacacatggacataaatacggaaacaatagacactgtggattactagagagtggaggaggtgttagttaaaaaactacctattaggtactatcctcactacctgtgggataggaatctgtattccaaacctgagcatcatgcaatattcctgtgtaacaaatctgcacatgtacctcctgtatctataaatggaaatttaaaaatcacattatataccataaacaaaatttctatttgtccattaaagttgaaaacaaatttatccattgaaattaaaatatattgctggttatatattctcaatatctcaataattaaagtcaaattaacacaaatattaagtcaataaaagtagtacagttgaaaaataaaaagaaaattccttgaggagaaaagtgacaccatatactatgctcacttgtcttggtttctttgtcatgtgaacaatgatctgaagattcttatactttactagctttctactctcttcaaaattaaaaagaaagtgtctaaagttttctagtagttatcagttgtgtggttaatatgaaaaacctctttcaccattgttctcagatcaatttttgatgaaataatccatctttgtttacttggcacatgtaactgtagtatgaatgaattgtacagtcctatcacaaatgtaggctatggtgtttgcagccagaaaacaaaaaccgattaaatctatagtttcaagggatgatcctggtgactatgtggaaaattgattgcactggaggtaaactggagtaagcatatcagagagtaagttactgcaaaaaagttgatgagtgtgaattagagcattcgaaacagagataaggtaatacggacatgtttttagttgtctttataaagaattaactgataattggaaaagagatgaggttttatgtcagtccttaccttatggatatgacatgatcctaagcttgaaatattgagtacatggtgagacattttttcaagacaagaaaaattagtaggaaaaatagtctttttcagggaaggtaaagtgttggattttgatcttgttgaatttgaagttaacagactcttctgaaaagtgaatgtagggataaaaagacaagttaataaggcattctaataccccatttctggttttccaataaccctttcaaattgaaactcagtgtaatcccataatcactgaagcctgtgggcaatatattttgctgagagctatggatataatgtatcttattctggtttgtgctgctcttacagaataccacagactgggtaatttataatgaacagaaatttatttttcacagttctgaagactggaaaatccaagatttagaggctagcatctgggaaaggtcttgctgtgtcattccatggtggaaggcagaagagcaagagagagagcccactcacgaaagtccttttattaatatattaaactcatttatcagggtagtgcccttatggtctaataatttctcaaaggtaccacctcttaatactgttacaatggcaattaagtttcaagatgagttttgaaggggaacaacactcaaatcatagcataatgcatatctccaaaatatcctaaaaatagtgggtagatttggagatacacttaaagaatcacagtaaattctactcttctgatttctaatttagtgctctttgcactatactatgaaatttgtggatgaaagttgatgggttagatgcaatagatactagaagagtaaaatcaacatgtttgcttactgaaaggttatgagaaagaagttagggccttctgagagaggaaaacctttaaaaaataattgtgattttcaaggtaatatgaatagatgaatattgatgtcaatgtaggaagacatcagagatttaaaaggtgatatactctgatccagtaatgtttgatggaccaaataaatctctacatgaacattagtcagacgaaaagggagatttatatctaaagctcaggaaaccatgactatattgtagaacatatggtctagcagactatgtaatacttacaaaccttgtttttgatgctatttatatttatgcagtttatatcacttttttggcaaacatcacactgttctattttcatacaaataaaaccactggatctctttcaagttaatagctgataagttaattcttaaaatatgtgtgcttgtaaactttgggtttctgaacccgaatgcagggcatgtagtatctctatgctaaattttaaattgttaatttttttattaccaatgtgtttcttatttttaaagaaacagagtgaaacattgtatctttaagtgtttgatcatccctacagtcacaaaatcaattgattcttaaaatatgccaaaactttttgcctcatttttaaaaaaaggtctttaatgataaggttacatgtatagacaaatttaaaaatagatgttgaaacaacagatacgagaaacagaaactaccattggatatgaaaaggtaaatttccagcacacatatgtaaaacaatgccacatatatggtgggaggaatgccctgatatgctaattattctacaattctcccaattctcatatgctaagataatgtcaatggatgatgaaaaactatcttttggacattttgtaacttaatgctctgaagcgtctggcttacacattttgtcaatgatctatctgagtgtttattgtctgcaaaaatgggcatatattggcatttcaatttttaactaatattcctagtctgccactgactatggtgaaatatttcctaagttcatgaatcactataaagatacttcctaaagccacttcctggcctgccatgatggcgtgtgcctgtaattccagcattttgtgaggctgaggtaggtggatcctttgtgatcaggaatttgagatcagcctgggcaacatggcaaaaccctatctctacaaaaaatacaaaaattagccgagtgtggtgacacgctgatagtctcagctactcgggaggctgaggtgcaaggattgcttgagcctggaaggttgaggctccagtgagccaagatcgagccactgcacttcatcctgggagacgagtgataccgtgtctcaaaaaataaaaatataaataaataaaatgaataaagccacttcccaaagttatcttaatgttgcatcattctatagtgacctggccacaaatattgacatgaaaaaattaaatgtaaaatatctatttcatttctaagagtagaaattataaagatctgtaggatagttttatgtcctctaactgttattttagaaaagccacagtggattacatgaaacagtcactggctgaattcacactttcctttttaatcttaagtagtttaatttttatataaaatgaaaactcaaaattcataagtgttttaaaaacaaagttgcatatataaatcaaaatattaggttaacaaaaaatacataaactcatataatattaaaggttgcctcaaggagtattttgaaattatattaaatggaagagaaaattattctagggttaagtgttaacaaagagagtttcacataatgacaagattttatcttgcaacatggtaaagagttgttgctcagaaacaaataggaacaaggaaagttataataatctggagcaagttcctgtgagaataagaaagagtctagagaaggaggaaagggaagtaatacctagagaaggaggaaagggaagtgatttaaaggatgtgccaatgatttccttagagacaatgaagaagttcatgtttctattgctattttacaaaggtcgagaaagaagtgaggatctaagggtttgaagaaaggaagaataaaacagatttaagagagtgaggcgcagagttagacacatgaaaagaaaaacaaaaaagacataagagtcaagaaatagagatagaaacctaagaacaaaagtgagattaaaaagtttgaatctctcagtgtaaaactaatcccttagaggaaagaatacatacttttgatgcaggcaaatcataggcttaattgatcatagcaaagttaataagcctctgagcttcagttctctcacatgtataatggtattataaaaacctaccttacagaatcattatgaagataaaagtatgtcaagtaattgtaagtgtgtatgtaataaaactgatgaaatctaaatcagttctgtaaattgtaaattttctgggttttatattgtactatatttatgcaagatattaacattagagtatacttctttaaaacttccagtgtatctataattatttcaaaataaaatatttgtaaaagtaggctgggtggtaataagttgaaaaaacattgttttttttttttgttgttttttttttttcagaagcatagggattcgattcatggagattctaattcctggagacaaatagagcagtataactttaatcccaagccatctcattttatttaacagctgtactaacaaactctccatacattagaaaatgatgctgttacagtgttatttatatcttccgccgaatttctgactgtcctgctgcatgattccagctttgcctcttgggccgcttttagaggatccaagtgtcatgacactaaaaggtataattatagttaaataaaagtattgcctactgagaaaataaggagaattattctccagaggctagcactagggatggtggtggaagatgatggttgaaattctaaaaagagacattttagctatacttacataaaacttatttcaaaatttgaattgaaaaatgagagatagtgctgtttggcatggtgaataggcatcaccgggcattttgacgctgaagttgaaacactcccggtttttgctcactgatttatctccatcactttgcatatggcctatcacttagtaagggtgaaaaatatttcttactaaaataacatatgactaacgtaatgactgagttacaatgaatgaaataatttgtgcaagagattcctacaagagcagacaatgcagcaagcagcttctacaatcccctgtaactgtgaggttttatgagtcaacataggtgggaataacccatgtgtaaaatctggacagaaacttggattccaaatccttgatactaatagcttcatcaagttagtcctagactgagtttaaaatatgggacatgttggaagagaaatagagtcgtgtgacaaggatagaaatgcaactgtcataaaggtaacaaaaattagataacttttccgagactagcattactttttcattctttgtcagcagcaagttttccaagcccatgatggaaaatgaagcttaaggcaatatggaacaatggaagtgaagccagtagagagtattttcctacatgagaattattctgttgggtctggttaaatagtgctttctctcttatacagaacataaattctagcagagaactaaagtttgaagtaagattgaacagtagaaacaatcagattcttgttccaggtctttatttgtcagaaagaaggacttcacctggggacataaacaagaaaggaacctcacctctgcctcaaatgaacattacataagctgtcactccctaatcacaagtagaaatagacctgaaaaataactgtgggaggaatcaacttggaacaaccaatgtcacttaaataatcagtctaacactgaactacttccttcctaaagagacctggcaacgaatgtgtttacagcatcactaaaagtcttgacaaggaacagccactccacaacaaaaatgagaccctttttttttttttttactgtaataaaagaaaaatgtatgttctctattgaaaaatatatattgccaatatatgttttctttacaaaaccataggtagtcacagatatttcaagaatggtctactatatttgaaattattttccataactaagttaatctctagtttcctttttatctcaatatttagaatctctggtgattttacctatgttttccagagtcaaattttatttttctctcactatggtcgtctactgacaagtataatataatatttaatgtttacaatactcctgtgaagtcattactcctatttaatatatgtggaaacagagaatcactgcttaagatcaagttgataataaatggcaggaacttccacttttaaccaaggactatcagggatcagctttactttcttctctgaagcacatacaaaatggaaaactatataaactgacaattttcacaacactgattatcaggcaaaaaaagacatcgatcccactgaaataggactcaaacacagtaagccgtgattaccccagattattgccttaaaagagtttcatgaacacagtgtatggaggcagcatgcaggctgagctcagcatactggctgaggtgaacagaaaagtggcaagacgaaggcagctatagttcacagtgcagagtaagagagaagagaggagcttcgtaagagagaactccagagatttgcagtattcatttgagacaagaattctcaagtgaacactcaagtattcagctgagtactgattagcacatatgtgtgaggaaacaattggagattcagaaaaaaaccaccaacagtattgacagaaacagaaactgtttctcaaatagggcttggaatagtgccttttccattttctttttaacttttattttaagttcaggggtgcatgtgcaagatgtgcaagttcattacataggtaaatgtttgtcatggggttttgttgtacagattattccatcacccaggtattaagcctagtatccattagttatttaatactgcattttcctataagcaacatagaaaaacaccatgactcatgggatattgagagagtacccaaaggtgtcttatatcaatgtgggtttatgctagggcaaccataaaaaaattcacagactgggtggcttaaacaagagacatttaatttctcacagtctggaggatacaattccatgatcaaggtgccagcaaacttggttattggtgagggctttcttcctggctggtagatggccaccttctcactgtgtcctcacctggccttgcctctttagttgcatgaagagagagagatctctggtgactcttctccttcttattttttcttcctcctcctcctcctccttcttattcttcttcttctttcctcctcctcctccttctccttcttcttcttcctcttcttctttttcttcttctttcctcctcctccttcttcttcttctttctttttctgtcttttccactaattttattggatgatctctccacccttaggtcctcatttaaccttaattacctccctaaaggccctatcttcaactatagggccattgaggattagagcttttctatagactgaatatttttgagccccatcaaattcatatgttgaaatttaatccccaatgtgatagtgtttggaaatttaccctttgggaggtgactaggtcatgaaggtggagccctaatgaatgaaattaactcccttatagaaggggtcccaaagagctctcttaccccatccaccatgtgtagacacagcaagaagacttttgtttatgagccaggaagtgggccttcaccagatggtagatcggctggcaccttaatcttggacgtctcagctttcagaactttaagaactaaatttctgccgtttacaagccacctggcttatgatattttgttatatcagcctgaccaagctgagacaggcttcaacatatgaaagggggtggggaggtgacataattcagcccataacagtggggaatatttaaccctaaactgtgcagtgatctggactcatctagacttcttttccttttaataatagcatccttttacttatttagctacttatttatttttatttttaaaatttgagttttttatgtcaagaaatttgcttatttattttttagttgaaacaaggtaattttacatatttacagttcatagacttcttaaaagcaaaacccggaggaatcaaaatattttcaagtatcataattgagtcctaaaataaaattcaagaacatgtctaaagatacaaaaaatccagtacccagtaagataaaattcataatgtatggtatccaataaaaattcatcaggcatgcaaagaaacaggaaagcataactcatgataaagagataaatcaatcaaaacctatccattaatgagtggcatcagtgaaaacagtagagtagggaatgccaaggttccagtcctctacagaaacaccaaaaaaaatggagtaaaatctaaatcaacttggagctctggaaaattgtcaagtgcttacaacaacaaagcaaatgctcaattaaaacataggtgattgaaacttgataaagaactttatgatgtttttaattaccctttttcccattcttctctcttgcttggtggcaattttgaaggtggaagcccacattcttgaatgggtccctaaatctagaagatttagaatataattgttctcaaggaattatgtctgtttggatctgtccggaggctccctcctgaagtattgatgtaagaggcttgcctttgtttcacctacccaggacgtttctcagagttgaaaagcagctacacagagggcatgcctagaaaacattaaaaggcaaataaacaagtccctgccatctgggcgaaagataagagttttgtcaaataatagacacactgaaagcctggggaaaataagctgggcaatgagataatgtgggagataaaaattttaaaatatcctacctataccattgaatctaggaagccacacatacccatcacgtgatgtatgctcagaaaagacctgataagatcctaagcttttccatctggctcatctttaggctcatggaaaataggaagcaaaagataaggcagtgttgtaaacagactagctaagcgtaaaagaagctattcaacgtagaaccaattagcacagtccaggaaagtgctttattttatttactttgctccaggtgttcaaggaaatttatcaggccactagcttatcactaagctaaaaggagagagatttcagagatcacaggcaacacagaatgtatttttaacaaaagtcatttggaaaagtcagtgaacaacaacaacacaacctaacaaccacaaaaagcagcaacaacaaacactggagagggagagaatctgatctccataattactatgttataacattgaaaatttacggttttcaacaacaaaattatgggacatgcaaaaaaataacctaaataaatacacacacacacgaaagtatggcccaaacgacgggaaaaaataaattaatgcaaactgtccctaaggaagctcacacattgaactcagtagacaaatactttaaatcaactgtcttcatatccttaaaaagaaaaaggaaaccatgaactaaggaataaaagaaatggggatagtacgagtctgagatgaaaaaagagggagagaaaagggaagcaagaatttttaaagaaataatgaccccaaactcaccaaatttgatgttaaaaacacaaataaacacatccaagacactcaatggtctccaagtaagataaacacaaagaaatacacaccaagacacattataatcaaactgttaaaagacagagagattcttgatagcagaaaaagagaagtggtttgtcccgtttaaggctatcctcagattaacacctgattttcatagaaaaccctaaagaattcacaaaaaattattagagctaatatgtaaattaagcagagtagcacaagatacaaaattaatatgcaaacaacagttatatttctgtacattagcaaggaacaatctgaaaagaaactaagaaaataattcgaatgccaatgacatcaaaatgaataaaatatttagaattaaccaacgaaatacaaaacttgcatactggaaactataaaatttaactataagaaatctaagaagatttaaaaaatgaaaagacgtttcacgtttatgtattagaagacttaatattgtttacatgacaatactttccaaagtgatttatagattcaatgcaatcactatcaaaatcacagtggccttttttgaaaaaaattgtcaagcttgtcctaaaatttatattgcattccaagggacacaggtagccaaattcatcatgaaaaataacaaaattagaggacttgcaattccaaatttcaaaacttactacaaagctatagtaatcaaaacagtttagtaactataataaggatagacgtttagcttaatgaaatagagttgaaagtccagaaattaagttatatctacagtcatatgatatttggcaagggtgccaaatcatttaatggggaaaatagtcttttcaaaaaatatttctgggacaactatgtatctacatatagaaatttgaagtgagaccatctgtctcctcacaccatatataaaagtttatttgaaacagaggaaaaatctaaatgtaagtggtaaaactataaaactcttagaagaaaacatatgggtaaaattcatttttttaaattaggtaatagattgttagataacatatgaaaagttcaagcaacgacaacaaactttaaaaagtaaataaattgaacatcaataaaatttaaaaaataacttttttgcattaaaggacactatcaagaaagtgaaaagacaacctaaatattgggagaaaatatgctgtatgtgaaatatctattattacattaatatagactgtgataagttaaagataataaatcataaattgttcacttgaacccatatttcaataccaaccctgttcttcctgttttatttccactgtattagggctagtgctagtttgggagccaccctatctcctgttatgccacatttttttttctctgattaatagtaacctgcaatttccaggttgtcacttatctgtccaggcattcaataggaattatgctgtgttttctttgtccctagctcaatgggggtaggggtggggggctctgaacaactgtttcctgctgtccatgattaatcaagctatgcagcaaaatcagtccacacaaaagccaatttcagtgtacaatgtgtagaaagaaaaggaggaaaagcagtaacccattccatccattaaaacagtggactcacatgtgatacgcctcgaggggcttttgcctttttttcagtgatgattctttagtgccagaatggtctgggtgatactagggggatgtagaagagctaatattattcttcacaaggttattggtactacacttctaatcttccatttttacaacagatgctggatgttactgacactggaatggcagaataagaaatgcaaaatagttgcatttcattataccctttaattgcactttacagcactatgcaaaagatttcctttataggactgaaggcacaacaatgcatttaaataaaaaaatacatgctggtgtgtcaaattagaatgccactttttgcctgtgcccaacaagttatttctgtgcttttttgttggtttgtttggcccacctcctctattaaactacagtttagcttcaaaattaataagacacaggcactaaacatatgcttaaatgtctacataaatcttattctcaaaagattaataccatctgttgattctgttttctaagttagccttgacagatttaacaatggacaaacgattagtttctagagatccttcatttattttctatgtgtttgactataaaagcttttgctttctgctgataataaagtatatctatagtaagtacctatttagaggttgggctagagttttcagcttaggaagtatcttacagactagttgtactatagttaccatgaaaactggtgaaatggaaaacataaagtggttttcattgcttttttattgatatatatcaataggagtattacatatttagggggtatatgtgatattttaatacctgtagagagtgtataatgataaaatcaggataatttcaatatccatcatttcatttaattgctttcatttatttattttttggatttttttttatttcaacttttagatatagggggtacatgtgtaggttttttacatgagaatattgcatgatactgaggtttgaggtatggatcctgtcacctaggtaatgagcatgatactcagtaggtagttttttcaacccattccccctccttcctttcccccctagtaatctgtagtggctgttgttcattgttcccatgtttatgagtgtgtgtgttcaatgtttagctggcacttataagtgaaaatgtgcaggatttggttttctgttcctgcattgacttgtttaagatgaaggcctccagttgcatctatgttgctgcaaaggacataatttcattcttttttatggctgtgtagagttccatgctgtatatgtaccacatgttctttatccaatcttccactgataggcacctgggttgactccatatctttgctattgtgaatagtgcagtgataaacagtgaatgtctttttggtagaatgatttattctccttttggtacataaccagtaacaggatggctgcatcaaatggtagctctattttaaattctttgagaagtcccccaactactttccacagtggctgggccaatttacattcccaccaacagtgtataagtgttcacttttctccacagcctcaccaacatcttttgtttcttgacattttaataattgccattctgaatagtgtaagatagtatctcattgtggttttgattgtatttctctaatgattagtgatatagagcatgtttccatatgtttttttttggctgcttgtatgtcttcttttgagaagtgtttgttcatgtcttttgctcatttttagtggggttcaaggagaaatacaaaacgctgctgaaataaatcagagacagtaaaaatagatgaaaaaacatgccatgctcttggatcggaagaatcaatatcaaaaatagccatactacacaaagcaatttacagattcagtgttattcctatcaaactaccaatgccattcttcacagaattagaaaaaacaaaagctactctaaaattcctatggagctgaaaatgagcccaaatagccaaaataatcttaaggaaaaagaacaaagctggaggaatcacactatccaacttcaaactacaatataaggctacagtaaccaaaatagcatggtactggtacaaaaacagacatgtaaaccaatggaacagaatagcccagaaacaaagctaaaaaaaaaaaaaaaaagaagaagaaaaagaaacaaagcttcacacctgcaaccatctgatgttcaacaaggtcgagaaaaacaagcaatggtgaaagggctccctattcaataaatggtgctgggataacctgctagccatattcagaagattgaaactggaccctccctttcatcgtgcacaaaaattaactcaaaatgagtcaaagaattaaatataacacctcaaactataaaaagcctagaacacaacctaggaaatattcttcttgacattgaccttggtaaagaatttttgggtaagtccccaaaagcaattgcaagaaaaacaaaaataggcaagtgtgacctaattaaactaaagagcttctgcacagcaaaataaactatcgacagagcaaacagataacctacagaatgggagaagatattatcaaaccatgcatctgacacaggcctactatctggaatctataaggaacttcaacaaatcatcaagcaaaaataataataataatctcattaattgtttttaaattacacttgtaagcaggttaaaacttagaaatattaatctctgccaataaattaaatatatagttccaagcttagatggggtgggaattgacacgcgagacacaagttgaatgaaaataaaaatgctatgatgttaactgaggttttctcaattatattaagacattgatattattaaaaggaaaacttgatacaaattaaatttaacagagtttaattaagcaaagaatgattcacaagtagagcactcccctgaaccaaaataggttcagagagactccagcgctaccacgtgtttggagagaatttatggacagaaaaaggaaagtgacttacagaaaactgaagtgaggtacaaaaatagctggactggtttcggcatggcatttgccttatttgaacatggtgtgagcagttggccacctttgactggctgaaacatgatgattggcaaaaagtaggttacagtctgtattcacgtccaattaggttacagttcactatgtgtggagaaaactttatgccaaacttataaggaggcagctttaagttaaacttaattgaacagtattcaaatatagtaatatattgaaggatggtgaagtacatatctcactgctagtgaaaaatattggatagttgaaatttcatcgcagttctacatttttatgaatcgattacagtcttcattcttcatttgttgaatattgttgattattcattacatcctatttgtatgtcattatatgtcaatctacgttctaataagctcagggctttaaatgtgaaccagtatgaaatctaactttaaactttcagctttctttttattcttttttaataaaacattgggttaaactaggacatccattttagaattcaataaaaacaattttaaaaagactgtaacttacagtgggttctccttccaacacattaaattccaaaacatgcattctgaaatgtaaacctcttgtgtttttaatatacaaatatttcaagtttcaaatttcaggatatcactgtcagccattctttattttatctatacagaattattttacagattttgagcacggcctacagtaagaaatacttcatacataatgattttcacacacatacatttatttctttaaatggaaaaaaattataaatgatttccttactatggccaagaactttaatattgtcttctactccactctattaatgggtcttgcagttgaaaagctcatttaataaatattgttgaaaataggctagattaaatagagaataaaatttatgaagacaaatattttctttgtcttctatggaggaaattcttcatattctcactaaatcattgataaaattgcaccctcttaattcattgtttcaccaattgctgtgaaatatggcccgaaatacactttcattgaaacggacttaatttctcagtagtttgaaaataaagcaagtagatattgaggacttccattacgactgtgtttgtgctaactatctaatgtcacttggaaaattgcactaaaacaagttggttggtgagttttaaatgtctgactattttcagctactttctatgagatcatgggaccctgtgagttagtggctgggtcaaaagtttttgtttgtttgcttgttttttggagacagggtttcactctcatcacctaggctggagtgcagtgcccagctaatttttgtattttttgtagagacagggtttcaccctgttgcccaggctggtctagaactcctgagctcaagtgatcctcctgcctaggcctcccaaagtgctgggattacaggtgcgagccactgcacccagcctgggtcaaaagttataggaaaactgctttatttaatatttcagaagaggtcataaattgagtgaaattgttaaaaagagtttttatatttcatctacacatgcaactcttatggattactatattatccatcatctatctatctatctatctatctatctatctatctatgtatctatctatattggttaacccactttttcacttacaacagagaatttcaatcattaaaaagtgtatttcaagtacttcaagtaatttgtttaaaagttagacattttaaacaaatcataatagaaaaacatcttgcaaaatttctatatcatccagacttcttgcttcttgtatctgtgtgtgtgcatgtgtgtgattataatgtatacagtatttgattatgatattttacttcttgtaacaagcaatatgaatttgaagcactcttttcttgcgataataccaagctatttcaattactttttagatttttatacctttcattttatttctttcttttgttttaaggagaataaaaagtgttactgagggacaggaagagaaatggagtcaaccttatagagggttcatataaacttttatagcaatatcaattaaagtttattagagggaaatatggatagaaatgctattttaggattgctgagtaatttattgattcatactcccatcctagtaaactcagctaaacactgattatcacagatatgcactttatcaccatagtccttattattgttcatgatcaccaatcatttactgatcagctctggagtgttagaaagcaaatggaacatccttgttttgtgaagtgttgaagcacaaaagggtattgatctgttgccacgttacattgccgattcatgtctagtctgtgattcaaagccgttcctcactttcttgcagaattattttttgtggatgtttcctcctaaccaaacctttttatgtgttttattaatgcttctcaagtgtagtcctttttacttcttttcatgtaacttccctgtcctttatgcctaatacaaaaattaacatttatgtgtgaaaaaggctatattcacccacaaaaaagttctcatgtcagaaaggtttagaattacaaatgactcagcaggccttttaaacttcaactcttcaaagcactattcttggtgttgtgaagaatcagggctaaaacatagctgttgccctcaaggtgctcatagtctacagtagctaggggttcaagggccagctctgcaatttcctatctgaatacagttgtgttcttcaaactgtttgttgtgagtcaattatactttggcaagtcaatttactgggtcatgatcaacttaaaaaataccaggacataagcagatagaatgtgatataatagaaaaaaaatcttgagttcattgcatgcaggaaaagtaaatttgctttgtgaaacatttgtctcacatataaagtatatgaatatacatattggatagtgaaataaaatgtattttatacttttcattgcaatcacatcaacctacatgtcaacctgagtgtcctgatcaatcgaagtgtccatcaatggataaatggataaaggaaatgtggtatatatacacaaagaaatactattagggcttaaaaagaatataattctgtaatttgcagcaacattaatggaactggagctcattaatttaaatgaaataagctacgcagaaagacagatattgcatgttctcactcatatgttggggctagaaaagtcaatctcatggaggcagagagtagaatgatggttacccgaggctgagaagggtaggggttccgagatgatgaagagagtctggttaatggatgcaaacatacaatcagagagaaggaataagttctagtgtttaacagcaccgtaaagtaactaagttaacaacaatatattgtgtgtttcaaaatagctagaaaataatatttgaaatattcccaatagtaagaaataataaatgtttgaggtgatagctatcccaaataccctgacatgatcactacgtattatatgcatatatcaaaatatcacatttaatccataaatatgtatacgtattatacatcaatttttttaaaaaaaattgaaagtgtgagaaacactgatttgaactatttcttttctctcatggagcttcagatctcttatctatataatataaataaaaataacagcaaacaatatgcatgtgcctactttgctaaaccctttagtagaataattcatttaattttcacaataacaaaaagatacacatttaacatgatttataaacttgccaatgctgaaattaaaaattgataggaccaagattgtaaataaggttggctacataaaaggaggacctaaattacagaactgataaaggataaatgatatgaaaagtgttaaatactatacaaatgtaaaatattatttagacaagaaaagtacaaattcaattttcatcgtaatataaagtgatgatttaacccaaagaaaactgtcgatacttatatattttattataaaacaattttctacatgttattttacctagtctgttttcattttaatttgttgaagtattttgcacatatctaaattttttattatcatatcccaattttaaggtagtctagatatgagttcacagcattcactcacttttaaagtagattgattttttgaaaataatctttattgtatatagtataggcaaataatcaatgaacttccaaaatcggtagcaaatttccacatattaacgaccttcatattttgagtctcatagaactaatctggcatatttgaaaagtaatagatgattaattctctgtataaaattatttcaacaagtaattatattttagatgtatttaaaatagcctgtatttatctcgctcaaattcaacaatgcatgtcgaaagtgaaacaaatcctgttcattcctgaactgacttacagtaataagaaactagaagtggacttagaagttgaaatttaatgatacattttacatttaggtgaatatggcttaaaaaagaatggataccaatttctgtagaattaacaaaaacacacaaagatactcaaaatgtgttatactcctcccaaacaagatataatgataccgatttaaataactttacagtcacaaatatcaattcaataagattatttatatagtaagatttctttaaagtagctgatattttaactctttgtcatgcaaaccattaagctcataagcatggattcttatcagccttcctcaagtctttacacttgtcataatccatattttttctttgcggaaggttccctatgaagtttgtctactttttaattcatggtgtgcaagaagaaaacgacaatatgaaatatatttgtcaattataaatttgtcatttatttaaatatcactatatcctgtaccaggtgtaaaaccttttgataaatctttttgagttgtcaggatcataacaaaattaattcaaaacaattgtacgtgataggcagtaaataaatctgccagattgtgagttttaaaaaaatagcatcactgtgcttcattcttttgacttgacaagtaatgaaaagaccttcattaggagaccatttcacagaatttgatgaataacttaaagacaaattaaagattgtaagactgtaagataaataaggagaaaatgaagaccactgtcgtttgccaaatgcatgacgtatttaactaatactcccatggaagtttctacttttcacaaaggaggtttacatattttcaagtgttttctcaaagtatctccacaaaggatctgcatcagattcatcttcaactcttgttaaaaaagcagagatttttaaaccccacttgagtcctactaagttagactctgtgaaggttagaatacaagatctttaattataaccatcttctgtggttaactgtattcataggaatctaagaaacatgcattttacaccagagcagaatccaaatcctgagtggatttatttagagcggagttctgccacctagagttttggaaattttcaggaaaattttggttgtcataatgattggggtgcactatgactggcattgagatggacagagcaggacagtcctgcactatacataaccatcccacatcctcgcaacttttgattattgtacttggcattcgtaaaagtgaaaactgttgtgatggttaatattaggtgtctacttgattgcattgaaggatgcctagagacctggtaaagtatcgtttccgggtgtgtcagaggagattgacatttgagtcagtggactgggagagcaagacccacgttccgtgtgggtgggcaccatccaatcagcttccagtgcagcaaaaacaaagcagatggaagaaagtgagataacgtggcttactaggtcttctagctttcatttttctcctgtgctggatgcttttcacaaaggaggtttacatattttcaagtgtacgtattttcagactccaggttcttcagcctttggattcttggactcacaccagtggtttccaggtgctctcaggccttcagccacatactgaaggctgcattgttggcttccctgcttttaaggctttgggactcagattgagccactactggcttcttccccagcttgcagacggcgtatcctgggacttcgccttgtgatcgtgtgagcccattctcactactaaactcccttttatgtaaacatatatcctattagttctgtcactctggagaaccctaatacaatcatatttacaatcatctgataacagagaccacttctgtttttgatataaacaaaacttctttgcaaggttctaatacactaggtttttattttggaatcactactgtataaatttaaagaaggctgtgcattgtttggtttagaattttatcaagttgtctgctatttttgaaaactgcatcagttgtggtaatgctgcccacatatttgatttgtcaatacagtgctcctctctcaggctgcatttgtagctgttgcatttatggtgattccatgcataggtgaaagcctgtaaatgcttcattagatcttctggtgtaatcaggcctgagcatcaacatactgaaatacatgtcattaatattatcagttactttccttttatttatcattaatattatagttaaagctttttaacttctcatttattttttggattaaggattataaagaaaatattacaaaatgttttcatgaaaaagattatattaggtgtgacaaagataagaaatgttgagaaagaattatcttagaccattctaggccagaactttttgtaagataatttcaaaacttccttctagaaaggattttcgattcctgatacaatgtttgtgcatctttctgttgcctctaaatgagattaagaatttataaggcctaagattacccaatttactggctgaatagcctaaagattgatttttcttatatttaaccaaatgcttaaatcgcctcaatcaagagtgatatggtttggctgtgtccccacccaaatctcatgttgaactgtattttgcataacccccatgtgtcatgggagggacccagtgggaggaaattgaatcatggagacagttacctccatactgttctcatgatatttagtgagttctcatgagatccaatggttttagaaggggcttcccccgcctttgctctgcatttctccttgctgctgccatgtgaagaaggacatgtttacttcctgttccaccatgattgtaagtttcctgaggcctcccagtcctgtggagctgtgagtcaattaaacctctttcctttgtaaattatccattctcaggtatgtctttattagcagtgagaacagactagtacaaggggtgattttgtcccccaagggaaatttgaccatatctggaaatagttttggttgtcacaactgttgggtgctactggcatttcatggctggatgctaaggaatctgttaatatattaggttggtgcacaagtaattgcggtttttgccaaatggcaaaaaccgcaattacttgtgcaccaacctaatactataatgcaccagatgcccaccccacccccacaaaacaaagaattatctagtacaaaattacccagtacaaaatgtcaaaatgccaaggctaaaagtttctactttagacagtctctttttcggtaatatgttcatccaaaaagggaatttttgaaatagtccaccctgagacctctccccttagtgctggcttgaaaaaaatttgacacaagcttacacataatgtagttgaaaagctgttttttccccttttatactatttaaagtaactagccctgaggaagctaaataaaaagacaagataaaatatgttattgagttgtaaagtttctagttatttctatggacttaacttattttttaatgtacagtgagatataagaaatcatcaccaaatatttataaattatgctagggctgtaagaaagttaataaataggaaattatactaagccatgttaaaaaagaaaataaggcttagggtgagatagaaataaagaggtaaatatttagaaaatgttgagcaggagaaattttttaaatttctaaccaagtgcctatgagagaatttgaaaataatgccaatattctaagtttttcattggcaataacaatgttaaaaggctttaaaagaaaaatttggcaccctcttctgattacatttcaatttaagagttctacagttcatatggaactaaaatagaacttaaatagccaaagcagtcctaagcataagaacaagctggaggcatcacattaccttacctcaattttttttttttttttttttgagacggagtctcactctgtcacccaggctggagtgcagtggcgcaatattggtgtactgcaagctccgcctcccaggttcacaccaatcattctcctgcctcagcctcccgagtagctgggactataggtccccgccaccacacctggctcattttttgcatttttagtagagacagggtttcaccgtgttagccaggatggtctcgatctcctgaccttgtgatccacctgtctcggcctcccaaagtgctgggattataggcatgagccactgcgcccggcccttacctcaaattatgctacaaagctacagtgactgaaacagcatggtactgggatgaaaatagacacacatttcaatagaacagaagaaggaacccagaaatagagatacatatttatagccaaataatctttgacaaagccaataaaagccccccaacatggaggaaggacatccttttcaataaatgatgctgggtaaattggctatctatatgcagaagaatgaagctggataccgatctgtcaccacatacaaaaaattactcaagatggatttaagacttaaatataagacctgaaactatacaaatactagaagaaaatctagggaaaattcttgtggacattggtctaggcaaataattcgtgactaagacctcaaaagcatgagcaacaacaaaaaataggcaattgggacttaaatgaaaaagctccctaacaacaaaatacataatcaacagagtgaacagacaacctacagaatgggagaaaatatttacaaactgtatgtcccacaggggactaataatccctaatttacagggaactcaataacaacaacaacaacaaacaaataacctcattataaagcaagcaaatgacataaatagacatttttcaaaggaagatatgcaaatggtcatcaaacatatgaaaaagtgataaacatcactaatcatcagagaaatgaaaactagaaccgcaatgagaaatcatcttacctcagtcagaatggctgttatttaaaaggtccaaatgtaacagatgatggtgagactgcagagaaaaagaaacacttagacactgttggtggaaatataaattagtataacctctacggaaaacctctatggagggttcacaaataactaaaaatttaactaccgtttcacctaacaatcccactactgcatataacgccaaaggaaaagaaattattatattaaaaaaactgtattcatatgtttattgcagcactatttacaataaaaaagatatggaatcaacccaagtgtccatcaacagatgaataaagagaatgtgttgtacgcacgtgcatgtgcacacgcacacacacacacacacacacaccagaatactactcagccataaaaaagaatgaaatcatgtattttgcagcaactggatggaactggaggttattatctcatgtgaaacacttcagaaataataagtcaaatactgcatgtgctcacttaaagtggaagctaaataatgtttacacatggacgtagaggatggaataatagatattgcagactttcaagggaggcagagggaggaggtgagggatgagaaattgctgaatggatataatgcacattattcaggtgatgggtatactaaaagtccagatttcactactatgcaatatacccatctaactctatgtacctgcaaaaattaaaaattaaaacattaaaaactaaaaaattgcacttgtaccccttaaatttatacaaataataggttattagttatccaaaataagagaaagctcaaaaataagcccaagtatttatggccaattgattttccacaaaggcaccagtaacacacaagggggaaagaacagtcttttcaataaatcatgctgggaatactagaagtccacatgaagaagaatgaaattgaacccttttctatacaaagcccaactcaaaatggacacaagacttaaacctaagacctgaaattctaaagcttgtagaagaaaacatagggcaaaactgcacaacattgttctggcaatgatttcttggctaggacttgaaaagcagttaacaataaacaaatagtttgatggcctcaaactaataaccttctgcccagaaaagtaaacagaatgaagagaccacccacaacttaggagaaaatatttgcaaaccatatgtctgataaggggctaatatccaaaatatataaggaactcaaccaatgtaatatatcaagaaaacaaataacaaaacttaaaattggagaactatctgaacagacatttatcaaaagaagagataagaataggttagagatacatgaaaaagtgctcaacatctctaattgtcaaggaaatgcaaattaaaaccacagtatggcctcatacttgtttaaagtggctattatcaaaagattaatgatagcacatgttggtgaggatgtggataaaaggaaactcttgtgctcttttagtggaaatgtcaagtaaccacaatcatttaggaaaatagtatggaggtttctcaaaaaactaaaaatagaattaccgtatgtgccagcaatcccacttctgtatgtgtatccaatgtaattgaagtccaaatgtaaaaaagatgtctgtattcccatgttcattgtggtattattctcagaagtcaagttatggaaacaacctaagtgtccatcagtggatgaatggaggaataaaaaaatatggtaaatataaacaatggaatactatacagcctttaaaaataaagtaattctgtcatctgcaacaatatggatggaactggaagacattatgctaggtgaaatatgacagacacagaaagacaaatactgcatgatctcacttctatatggaatgtaaaattgtccatctcgtagaaacagataatagaaaggttaccagaggcttgggttaggaagagggatggggaaaggaaaggtgttgatgaaagtatacaacatttcagttagacttgagagattaattttagtgaccttttgcactgcattgtgatcacagttaataacagtaaattgtatacttcaaaactgccaaaaagaacacatttttaaccatcccatcagaaaaaaaaaagatgaattttgtagggtgatggatatgttaagtagcttgagtctttctgtaatgtatatacatagatcaaaacatcacattttaacccataaacatacacaattattattcatcaagtataaataaagctaaaaaatacataaaataatgcattttcccaaattttaaatatccaggctaaagtgtccttcttagtgctaagcaaaaccaaatttctttctaccaactgggatttatggggaggccagcctcaacacaagccttccaaagagcggagagtaaagaaggagaaagacggcagcctttttctggggttatgaaaatattcatatgctgttcagctataaaaaaataaagttagtcaagtttaaaaataaatatgggagcagcaatatataaattggaaaattgcttagacattcttatgagatgaaaattaccttcctagaattttaagattagcttactcagacatataaacattccctgctaattgcaaatgcacatattataatagcaagttcccaagttgcacactaaatttctttgaaatcttcaatgatttcatatgtatatgttgacatctactggaccataattctagttttgttcctttttttcaattgtgagagacacgtaatgtagttcaaataataaagcctctcagttaacagggagcacacacacaaacacacatacaaacacatacatgaatctgttatcatgtcctaaattcctcatcaatcattgtgaagcgtgtgtgttcttatatccgatttaaagtagcacaggagataggtacaaatctagaataatctcttgggtttcaaattcagaattgtcatactaaatcatgtgacatgtttccacttctatatcccatatcaaagttatggagagattcatgatacctcaatccaggcaattttggcatttaccttcagaaaagttgaggagatatttagcaagctaaagtggttaaagatatgataattgaatgcaatgcatgatcttgaattcagtcctgaattggaaaaaatgctaaaaattataatgttgaggcaatttgtaaaatttgaacatggactctacattttataataatattgtatcaatttcaaatttcctgacattgatcattgtggtgttgtaatgcaatataatctcctagatattaggacattcataatgaagatttcaggaataaagcatctgcatatttgcaatttacccttaaatggttagcaataatagtaataacttaattaccattattatttttcctgttgttattattgttgttatgtactatagtaataatagtatatgcagtggatgctgtggtgtcttctgggtcaaggctgtcttctaccacctgctaagaacatcagctgccaactcacacagctacataactcactggaaaatgtactcaactttagggaaatggcttgtgcaaaattagatccctgctcaggaaacaacccttggccaatgactggttaatgtagtgataaaaaatgttctggccttcctccctcaatttatgacaatgctgaagtatcatctagctttagagctccttataaaattgactgaggcttctgttgccatgggattatgggtcacgttacctctctacctagtccttccttccacaattgcctcacaggaaaatcttcctaagagcatctccttaaagtatgccttaataaatctgctcataattaaccttgtaagagtctgtttcctaggaactatctcgaagacaatttgtaccaggtgtggtccttggaagcaaatgttaaacaggaatttgaggaatatgttacctgctggccagcaggcgaaaagatccagacactgataataggtagagtatggttacttcctgacatacgctggagtggtacatttgttaaaatattcaccaatgatggacataaacgtgatactggtataaaagaaccctctggcaggtgaaatatctctgatgtttaagtggtgtaaagaaaaaattccataaatatagaattgaatggctgctgctatgcatcaactattcctggaagagagataatatcagtctgaaagagattaatcaccatttcaaggcaaaacctgaaagtcagaggatatccttggaagtatttaatgagaccttaatctgctgccccccaaaaatagacaaagcagaggaacaggctctaaactgaattctgtgagtcatggagcttctgagagtgtagacttctcagcctcaacaagtgtcttatgtcaaagtcagggccctcgtagaaattatatgggttctggatgaacttgaatatagttccactcccctatgttagaaattactgcacaccttgtcaccctttaagggcatgaaaaagcaatgaaaaggaaatctgcctctctcatcaacctcccttgtcacctctcttcctggaaagcacacaagaacaagggtgaaattccagtgtaacttgtgtggagatgtgctaagcttgataggtgcagagaagaactatatgtggaagcaggtggctggtatgtactggaaggagcaaggataatgcgtatggaactggatgctgagggttctagattaaaggagcagaaaatagagttggttaatggacgatgtatagatatgtaagttctttctcatgatacaggattttaacaccatagcaaggactccaagtgaaggcattaacatgctttggagatggctcttggaatcttgggaaaagtgaaggaccacactaaacaaagtgaaaatacctgaaatgctgtgacagacagtgaggcagatgattaaaaagctcagagaagtggacatgctagatgaatatctttaatgttggaaaacttataagatgaccatgattcaaaagaaagcctgaagtatcttcaattgactaaagtgataaagaatgtactggaaaaataaacaaggatatcactgagaaattcagtatttgccatcttctttgggcagggctgatggtagaagattctgttacagaactcacttctctgatagcaatgatgaagataggaatacaaaacatcagaggcaagtttgaggtcctcacctgttacaagtgggcacaattattgcaataaatgtcaacatcagagtggcttccaagacagctaagaagatgtttaataaaatatgatagtcctagtctgaagatagatagatagcccatgagattattggtaaatatatgcaatcgaaagaaatccaaaatggattattaggagtctgagggcagttgtccatccaaaaattcacagtcctttgtgacttttctggagctgaaccaattctcaaaatgatactcactgctgagggagatactgtgtccatatgtgaagtagtccgtcctgaagcaccctaataagtgtattcattagcaatttccccagtctttccctaaggttagctgttatcatgtagtaaggtagttatacattggggaaaggggatgccaaaatctttcaaggatgattggatataggatagtagacagggacccaaagtgccaagattggactaatctgtattagttatttattgctgccaatgaaatcaccaaaaactcaatgacttaaatcaataatattaatttatcttatggtttctgtgggttaggtattcacaagtagctcaggtaggtggtttggctcagggtttactatgaggttgcagttaagaggttagctgggggtcacgttatttcaagacattactggatctggacaattcacttcttagtggtgactgtattagtctattctgtctgttataacaaaaaatccctagactagatggcttaaataccaaatttcatttctcccagtcctagaagctaggaagtctaaaatcaagtcaccagtagatccagtctgttgagggctggctttctggcatgtagagagccacctttttgctgtgtccttacatagcagagagacagagagaaagagagacagagacagagacagagagagcatgaacaagctctcttgtgtgcctcttcttctaagggcactcatctcatcatgggggcttaaccctcatgatctaattgcttcccaaaggccccacgtccaaatattatactattgggagttatggtttcaacatatgaattttagggagggcgtacccaaacatggagtccatacagtgactaactcacatgactagtaagttagtgctaagtgttggtgggaggcctcaaacatttccctggtggatctattccaggactgcttaaatgaccttaaaacatactggctggctttactcagagagggggatccaagttgccaaggtggaagtggcaatgtcttttgtgattcaacctcagaagacacacatcgtcacttccaccatattttatttgttagatgcaattcactaaattgaacccctattcaaaggagagaaattaggctgtactttttgaagggaagaatgtcaagtagtatgtggacatatttaaaaactgccacagcccttttagtatggggcacggtgagagctaggtaataaatggagtccatagactcaattggtggtcattttcctggtctcaaaatatataactgaaatgaacttactttgtagtagggacacccctcatattagttccatgatttgtgaagtaaaatctgttttattgagagggtgccaagtaggcacctatgatataatcaacctatcagccaatacaaccaatcaaaaataatacctcatcccagaaaaaatggcagaaattagtggcacattcaaatacaatttaattaacatagcacatacaacaaggaacgattcatgaacttaagcaagtaggaaattaagttgcagctctgggactggacatggcatttttgctagagaaaattagcatggattctaatgtgtgttatgtggttcctgcttccaaaaatgcatttttaccattcctatcacaaaggcaaatcagaaacagttcatattcagttggggctggaatgaatatatattaacaatcttgccccagaggttgggttaaccagaattccctggtttaatttaagtaatgatacttaaactgaagtgacttggaacatttgaacattgtgcaaatcattgcattagtctaatgtgttaggtattatttgcccccaggtaccacagattcatctcgaatacatcattccactaccttttgttatgacagtagtttctggttgatgatatccatgataggaacattgggttccatggttatgtgatcatggtgtacctaatttgctgtaccatgggttccttggttaaaggttaagttatttgatatatcatacctggaaataatataccttataaatcctcatagtagtgatagcttaagtcctgcaggtagataaagtaaaaccatagttgtggtgaaggtcttcattcccagagggtatttccaacataagacacaataagagtttcattgaactttttgctatggctcctgtttgaagatttttggctccttctgctaaaagagcagtgggcaaagaaggtagccaccatactggcaagggtaattaccctgaaattaggaggagacaggttgctgttacaacaatacttgtaggaaataataagttgagtgcttaggcgattcactggagatctcttgtgtttccatgcccaattttaactataaaagtgcaataaggatggtctgggaatggtgtaataatgagtggttcaaacccggtccccaatccccaccaccagtagataggggtctaggtgatcaaatcaggcaagccttctcatccagcggaattgcctgtgagggtgaggaaaatgtagaacaaatagtggaaggggaagacatgtattagttatggattcaggaccaacaataacagtgaaggatgtagtttagcccactaatcatcctcttataaatttatccaggaatagtgactatatggacagctatacctagaaggagtcaatttgaattgaaaaacaaatggatctgtgcagtaccagtgtcaaagggtagagtctggtagatgccatttggtgccctaccagagccaatttcctagattagtacacctcagctgctgtgaatgttggctcccaattaatgtcttacacctgcaagctttgcttgaggattgttctgggctggtgggagctcatctttcctttgaaaggttatgcctctccattaccttctcccctttgtaaatagccaacgattaactgatataaagatacataaagctggcctccttccttcaaggcaggccacccatttggtatgatttatgtcccagagatacctcatcactccacttcagcagatctggctgagccaagatttctaggcaatactgtatccttgatgggttgtttctttttcattatcctgcttgtttaacttctcttacaggtctttcctcaagagcacaccttcagtaaaacacatacatctgagaccctgcctcagcctatgcttctgaggaatgcaaactaagaccctgataggcatttaatatttttgcttcttggtttgtttattttgtcaaagcacatgaatgaatgaataaatgaatttgacataccactaaaagaatgtaaaaagaaacacaatgaatgcaaatatgacataaaaactgctttatttttagctgtagaaaaatgcaagttgaaacaagtccattaggtaatatcttcaagaaaagtataaagaatttttaatctgattgaaaagggcaagaattggaatggcaaaattgtgagtctaggaaattaagttctatttaattagtgcagaaaaaggggtgcatgttttattcaatagtgcactggggcactattattactttataaatattaatcattagacaggataaccaaagatattttaaatgatttataataaaactatacatttgatgactctttggtcacattattaagtttaaagcatcatatgtaagtgattacagttccttgttaatttggattatttttctttacttttaactattttttaagaaacgttaaattttagagcttcaagggaccttagaagtcatataaacctaccccataattttacagataagaaaaaaaactagaaagatcatttactattaaatttacataaatgtcatgtaatccgttatccttatattttcatattatttgaacaatttgtctcatgtgatttacatataaaatatttttttaacaaccagatattcaaactacacatatcctgtctatggtaattcactatttaatatactctaagagctttcaaagactctttttcaataacaagtatattggctttttcagatcattgattacataacaatgtactgttaggtagttgtttctctcactgaagatcaggccaaaggtgggcctttcttcaaagaaagatgatgcctaggtcagggtgttattttgttttagaatggtaagagcaattgctcattgaatctttcatcaaattttccacaaggcgtacaatcaagaataaacaactcttagaaattttaacttgtaaatataagtatatatttcccgtcagccctgttgtatctctaggtctgagtgttagaattatgctaattaactaattgtctaccaaacacaagctctgaattatcacataataaataatttctaggccttgattcctgtgctagactgttgatctatagagataattaaacacatcgttgtgtttactcagaagacaatacattgttttgtctactttttaaaattcatttttatttcttacatatatcaggcactcagaaagtgatgcaaaatattgtgttgtaaattaaggacataacatatttcacagaatacctggcaaaatagatatgagcatattcaaggcagtaatgaggataaaagaactcttcaaaagtaaaaacataaaataatttaaaaagaagataaaagaatatttccatcttgcagacctcttttgagtagtaaaattagcttctttgtaggtaacaactaacagctcaaacaatggttaagtttgatttgattatgagacagccaggtgggaagtgctccctggcagaacctccaaccgtcctgcatgctggaagaaatgtgcactcaggtagagccacagaagcttgcagcgggaaggaaccagggcctcctcttcctgggtggaacctgggattcagagtgcaaggtgggaagtacactagcaggactctggctttgctgaagttccctgtttcccttttttcccctttttgccaaataaattcaacttttctcacccttcaaagtgtctgtgagcctaatctctcatgactgtgtgacaagaacccagctcttagctgaacaaaggaaaaagtcctgcaacagctttggtgcccagaagctaaagcttgagaaggggtgggtgaaatgggggatcaaaacctctcactgtcacttgtaagccttttcatcctcagacttctgagggtaggggaaacccctgtcgctcccaggggtcggtggcctttccatggccttttccttccttttttgggacagacaggcgagtggcagctcctcgctccccctctcctcctggctggggctggtgaacatcatgtgtccctggcatcttccctaccctggacaaggggttcagctctttgggacagcaattaagtttttctccctggtggaggaacatttgcataagaataagaggttcttcccccatgcatccttttttcttcttcaccccatcagcagttaacttttaaatgggtttgttttccttttggaagatgttttactaagctaggaatgataaggatcactgtttatattctctgtaaagttttggttgtgataagggatcttgtggggactgggttttctcccgtctgtctgtgtagctgtatatgtgttgagtgtgtaacgtctataaaaagagctttaattaatttggcctaaaggaagacaagcacttggatcaaatattttttaaagggaatataaaagctgtagtacttttcagttcacgtgactttaatctttcagaaataaaaacagctttaaagattattggtaaaatgcagatgccatcaaaatgtaaacaggtcaactaaattttgcaggtcagatgcaaggtttgctaagtgttttaaggttataaagtgctttttgggttttgagaactatttgacttgctggtttcacagttggtacatacggggacatacagaattaaccacacccttaattatgctgaaaggagtcaaaccttggtcgcacttagcacacaattaacacaacttaccaggttttacattaacgttaaaaattggtaggagttaccattatagcatgtaattgaaactactggaaatagatttacacgtgaggtgcgtaggaatagtaaaatgtgtttttttagtaaaagattataaaaaggcctaaagatataaattcttgcctattattaaaggactgttttaaattagataagataaaggtaaaaattcaaacaactggtggaaggattgtaagaactaatcttgtaaaagaaattctgtgtgtgaacactgactaaattaaagaggttattatatggtttttctataaattgaacattgaaataaaagcacaacaaggttttcttaaggcactaatctgctcttataacaaaatttgtaaaaggctgtaaaaggattttgcttctttaaaatttgagtcatcatttaggcaaaataaataatttatggtaacccggaattctatttcataaatcaagtgttttaaacctttaacatatgtaacaggcttcccaaaatcaaacttcagtttcaaaattgtctttcttgacacctggttttttggaggctccagaagggcccctggaatgtccagaaaagaggcaaataggattatttggcatgtttaggtacatgggattgccaaaatgatgttcaatcttctttaggttatatttttgtgaataatggtaatatatgttccaaaattttatgggatttctaaaattcgaatgtctgagtatatactatcaatcataattaaggttgttagtttaagttatcgtaaaccacggaggtaatcaaacttctttgtcaattgtgtttgtaactgtaactaccctggacattttgctattcacagacaattgtcttgtttaaatctttttaaaaggaaggtttataatcagctatagcactttgacaggtgctctcaactacaggcttctgataactttggagattgtgacattgaaataaagaaaaatggacaggactcatgaagagctgaaatgttcacaaatatcaagcaaaacaagagttaactaagaggactgaactcaggaaactaaagcaaatctttttgagttttcttggaatattgctgatccttgtctttttttttttcagagtcaagaaaacttattttgaaccatttgtgacctttaataattgagtatggtatactcctgtgaaccaaatttggtgcatgtttgtgtctctctgcccagttcctctagaatttgaaaactatctgagtattcataacttatagcaatatagttgtttgcatcagtgcaataagaatctatttttcttttgcaacagaatgtaattagagaaactgcttactttgccaaggctttgactggaagggtatgcttccctttaaggggtcagtcttgacttgcagagctgataaaagccccttggggagactggcctcatacccttacctatgcaatccctgtatagggttctgacttgtgcttagtagagaatgtcactttctcagaggtccaggagctccaactttatctcgggaccttaagaggagaggatcacccaactcacaggtatctgagtatatatccatgactgggctcagccttaaaaggtcttatctgagaatccttgtggaacagagttccttcaaagacaatccaaaaggcctatgtagaaataattattcgtgctgcaatttatacaaataatcaggtcaagtgtttaagactaacgtctattttgcaaaccactcagtcttatgatgatttgttttcttttgacaaaaatgagcactggagagagataagttatgtttcaaaagttatcatacatttttcattaaattctagactcattagttgcttttaagtttttgcctacatttttagactagccctgcttgttcttgtgaaccaaccagcaatctctgggtgcagctcagaaagaacacgggagatgggtaatgtaaacatctggatcaatattctagttttgagcaattatcccgcaaatgctgccaggtgatgacaataaatagggtgccaatcactcagaggtttcctttttgggaaagtaaggccaagggagctaaccaaagccaagtaccatgcacccaaatcgtagcgagcataaatatagccaccagttatctgggtgtgtcacaagacacccttttctctcccttgttggaggatgtctcaattccacagcttcgccttagcgtttgtcttatgataaggagtccaggcaacccctgccaagacacatttttgtcccaaactcaattctaagcttcaggtcaaagccctaggaaggaaaacttgatctaaggcatccagaggcaaacaataacagaggaaaaaaggcacagtgcaagtgaacgtggctaattcctgcctattaagccaagcctcctctttcatggataaaggttatgctagtatccatggcataaatgaggtctagggaacaccaaggctactgacagtaggtgggatagagacataggtgagagtggataatttctattttccaggccctccctgcttcataggtgcaagccactttggcatccatggtggcacctgccaaggtctccaggactcagagttacaaggatgaaagacggaaacaggatgctcttccttctctcccccacgtactctgggtatctgctaggaagagaagggaaccagggatgcctgctcccctctttctagatgggtagccattcatcttcagtctgtacccatttcaaatgcatcctgaactcccgggactcctttgaaaaaatgccttctttttcctttctcttcctctgtcctctcttcactgataggtaattatgtcttcatactacaggacaatcacctgagatgcatcctccaaactgacaaaagtttattttccaaactttaaactggttggcttaggattgggctcagggtaaagtaactcagaaacccaacataccagcaaaacggaaaagtttattacgagttgggcttttggcctccctctacctgtgcaaagtcataaaaggccttgggatttttgagctttccttacccctccccttgtttcattttgataaatgttttctaataacccagtttgtctcttcttgccttcatgccctcaaacttcaaacagtcatgcaactggagccttggagtattgccctttctgctagggacccttagataggcctctgagggagatctgattgccattttccctcaaaacagcaccccctatcagtaggaagcagttaagatcagtcttcacccttactcctatgcttattctaacaggagttagatgtacttctttagaggggggaacgaggcagtcaagtgggaatggctccctggcagaacctctgactgacctgcccactgggaggaatgtgcactcaggtggagccacagaagtgtgcagtggggaggagcctggcccctcctcttccggggtctaacctgggattcaatctgtgaggcaggaagcacgctaacaggactgtggcttagtggaacattcctgtttttcctttttgccctttttgcccaaataattccatttttttcaccattcaaagtgtctgcgagcctaatctctcatggccatgtgacaaggacctggctcttagctgaaaaaggaaaacgtcctacaaattagaaatacatttattggagatattggttaacatactgaatttagagacctagtctgtgaaagactggtaactcagatacattttaactctcgatagttttattcacacactacagtaaggcagcacatagttctagttcaaaaacctcaaggacaacatttagggttgagtaacttgtgtgttaccaatcacttgattgttcataaaatgatatcttccagatacttttttaggacccaacttgcataattacagttggtgatcttgtaagtcacaacagtttgacactgttgaggtagggtgactaaaattataaattgaacggagagatttttctaatgagaaaaggcaaaaagcaactctagaacgctaaaatctgagaatgatttgatttagaaaatcatcagagttgtggctagaataacaaaatggatattagccaccaaatttcagaacatttaaaatagatgttagaccatgaagataaatgttcacttaagacaaatagagagtagataggatcaagcaaaagtgatatacatgtccagtggaattattatgaaagatttaataatttttctagtttataatttattactgtggaagaaaattattactcttacactcttgtctttggagtctatactagagtcaaacctcttgctaatatggaaattcttgtatttattgaatatttcaaattataattgagaagtaatgccagtaagggttatctagtttaaaatttcccaataatgttgtaaactatatgttagggaaagagcattttcaatttggggaatgaaaaatctgcttgagctagacttagaccttgttaaatgagtatgatttaaaatgtcagagaaaataagggtgtaggacattttacagaaaaaaaaagcaaaagcaaacacaaaacaataattgtctatgtaaagaattgctctagtttcaataaaggaaaatgtgtattttaattaatctaatatatatttatgtatatgtttatataaattgtatatgtatttcagatagtaatatttggggggaaatgacaaaagtacatgttgatttaaaaactactatatttcttctatgtttttagagattgaagttcaactattcttttttttttttcttttgagatgggatcttactctgttgcccaagctcagtgcagtggcatgatcatagtttgttgcagcctcaacctcccaggctcaagcaattctcctggcttagcctcctgagtagctgggactacaggcatgcaccaccatgcagcaccaccagctaatttttgatgtttttgtagagacaaggtctcactatgttgcccaggctggtttcaaacccctggactcaagcaatcctcctgcgtcagcctcccaaagtgttgggattacaggtgtaagccactgcatccagtcctcaactattccataattttgttaaagacataaagctaaatcttttaataaatattttctttatataatgtaaatgtaaatcagcaatgctattttgtatgtcatgacattgagttgtcagacaaatcttactaattatgttgaagactctactttatgaccatcttgcaagttcagtgaaacaaaacctggagactgaaacaagaattaaaagaagaggagaaataaactgctgtaattccctgagccaatagagagacaacacagctaacttctctctcaaatgtttgaaagctcctgaagggaaaagaggagaaatctaggtagagctccagagtgtggaattagcaagagtccaaggaccctcaagaattctctgaaaggagagtcataaagatgtgaataatcacacagtgtatcttctaacacgggaaagggttcgatgggagaaagtgtccctcaggaagaacagcaatttctttaactccgctgcatggaaataaggaatccaagtttacttcagcttgtgaggaagaatgggttatattcaatagtagactaggtgaatcaatccttctgtctgatcaactacgaccttctatccattacacaaatcctaaaagtgatgtccattatggcacaggaatatgtgcacctgaaaaagtcagttctagggtagaaaaacatccagttaaaagctgccagaggtgtgcacctacttagagaagaagacttgaagacttctttgttggggagaaaatatttgatttatacaaatgtaaggcaaatattgtattctgaaatagtgaggatccaggcaatagagtgtgctcttctgcaaaataatttgtaatagctctcaaatttggcatgagtgagaatcacgtggaaaatttgtcaaaaatactggcacctggcattctgattcattagacaggaattgacatcagacatctgaatttaaaaacagaaaagcctgctctgatgattcaaattcatgtcaacatctaagaaaaaaaatcccaatatattttttcttcattatttgcaaagggaggttttctaaagccttgcaattatatttccattttgaaatataagtgatattttttccttcgttcttgtctaaggtttgaactgaagacttctctttcatatggcagaagcaaatgatttctatagtgctgtgtcaaaccaaaagttaatgttaaagagatgtatttaggaaatgtgtggaatcccttgctctatgtatttgagaaggaatcacaccaaatatatagttttaacttatccccattgtttgtggtagtggtggtggtgttgatatccccgagcattcaataaggttttagatactgttgcattttatagctctgctctgagaaataaaaatatggacttgtgtccatggatggagaaaagttataggataggtgtcataacagaccagggaaaaccagtatgaaggaaagaagtaatatgaaaaatagagaaagaggagtccaaaaaatgagctaaagtgacgatccaaaatcaggatgtttttgtggaacatgcaatacttttgagatacctagaaaaatactgcaaagagaatttgggaaaagcctggaattccagtcaagtggcatgaggactcagctacaatttgggcattccatggtgctatgaatcttgaagcctggaaaaatcaggaaaacctgcataacatttctaatgcctccatttcatgctaatcagtgaaggccagatataaattgagtaaagaagtaaagaaaatgtcacaactttcatttagggtgtcatcaatcccataatgaataaacttgaacttttgggaaatgcatgtggcttttggaatcactatatccatatgacctcacatttcctcagcctgaccaccagtaacataactccagctgctttagtgtttgggaggtgacaatccaaatcaatgttaagtgtaaaagtatagcaataactggcttaagttcaaccactcaactggctctttttccaaagcagaaggatactctctctgcctctattgaaatgttgacatgggcctttttcatataccattgaaaggaaatacaagaaaataatatgactttcaaatgcaaaactaacgtcagcacggcaaaccagagtgatttcacagatttatattttttaggaaaatcagttttctaattttgtcagtttataagacactggcattgttaaaatgatattcttagtcaccattgaacataatgcttcccatgtaggagaacatagttccaatcctcaggtaattatcaaataactacttcaaggaatattcaatatgattccacatatgtacacatataataattagagtaaggtatttgtggttgcctgaaattattataatgagatatatttcaggatttccccaaatcaaatgtgcttgtttaactgcagtagaactgaggattatatttttggaaacttttctcctattgagcactctccacccttcgttatctttgaccttttctagtatcatagttgtaccctgatctcagatgtatacctctagcttagactttggacctttctcatgaacaccagtcttatgtattcaactgactcttcaacatctacatttggataatgggcatttttaaatcaacaagtacaaaatagaggtcttgatcttcccccttctaaactgattctttcacagtccttccatatccgttaatagcaacttcacattaagttatttagccttaaaatcttggagtcatccttgactcctacttatgactgtttacagcctgtcagtaaatcctgttgccattcctggactgagccaccatcattctggaccatgtatattgcctccaaagagtatgtatatatgtgtttatgttcaaatcatataaccagtatctatgatgatatatattttccatatttttaaatcagtttgtaccagcaaccagttgcctacagccagttacattgttattcaaattgcatggaacaccctaagaagatgatctgttctatttcatctaacattcaaattttatgtaaccagatagaaggattctagattctatattatatgatatttatattgtataacaccacataaaaattgaggaaaagtaatttaagtagttacttttacttcttctacaatttactctcagtacggagttatcctgttgaaaccttaaaagcaagtgaaatctctgcttaaaagcctactcgtagctttaatctcactcagaataaaagactaaggccttacaaggattttacacggctttcacagtttacagcctatatgtcttttacctcattttgtatcactctctcccttacataccttttttccagccacactggtttccttgctgaattctgtcaaaccaggatgttctaacccccaggcttctatacttttagtgttctctgtcatgaactcgctctgcttagttataaaacggtttgtttcctcatttccttcggattttgctgaaatatcacctccagaaggtttctctgatcaccctattctaaatttaatacctcttctatttcttcttgttttcttgttcactgtagcacattctatattttacttacatgttttatttgctatgttgtcttcacagaaatgcaagctcctcatgaatttgtgcttgattttttcattgctgtaaccctctattttaattgcccctggcacatatttgtggcttaaaaaataaatatttgttgctgagtcaattaatgaattcagtgttgagcaatatttttctgtataccactgccttgactgctgtgaaaatcttataaaaggatccaagtaattagttgaaaatgtacgattaccacattatgttttgttcctttcttttgggtttcctattgggtaaatctagtttctgtttgtaatgatgttttattcatttgaaacaatattccttcccaatttttaatggaatgtaaacttcatgaagatgcatcagcaattttatttcccattttgaaatttctttctcatattacacaaaattgtacaatttgacactgttaggaattttatagagctgtctaggctgatttgaagtgattttccctcatcactccttgactacaccgtttaattcacatgacaaattgaacaaaagagcacatagagttacaacctgtagatctttaattagtgtcttcattatccagaggcacacatttataatcctctagagtccttgctgtgatgcatagaagatggctggctaaatctgatgagttaatatactcagatactgttattttcctctaaacttatttttttacccccaaaataagacagtattttgtacattttacttcttgatataaagacaggaggatatgtgtaagcagaatataactgcttaccttcaataaaacaattctaatatgttttcaggtttcagtacagaaacattgttaatacataatataattatggcatcagaccattgattctgggaggtttcatttgttcatgcttaaaattacagttgcacagacaatcctagtactattcaatcatttgcagttatttttctatatttctgtgtttatatattcattttaatattttatttattctgatatctatacacattaacatttagaccattcagctgactttttaaaaacaatgaaacagatgtcatttaatttttttaccgatatttccatgaaggtttcagtattgctcttttgtctgaatttttgttataaatatgaaaatatgtttcccatgagtagatattattttgtaaaaaaaacagtaaactaatttatgaactcttatatataacaaaatcaaacaattttatggactgtaatgttttctccatttctactacatttttgtgtgctttatacgtttctattatagcacttacctaaattacgtattcatttgcatgtctttctcttgtatctatagacttgtgcctaggattctgcttgatcttaaaacttactcatgaaggtttttaaataaatggtattatcatcatgggtgaatgtatgatgaatctactttgtgctaaatagttttctttgtaaatcttttgctagtttttacaatttatagagtatttttctttttgagggatatacacttatttggtcttcttggtttccagattcaaactggaaatatgttcataatttctttaattctattttatagtcatcaaggaaaatgggggtgttcattttatgtattagtttgtttcctattagtaaattgtagtaatttctcttatttatacatctagaacatttctcttgttgttggttaaatgtactagatcctcaccaaactgctctaacataataatacctttctcttgtgccaaacatatactgtattcattttccctttcctatttgtagaggcttcattctctttttcactattgtggtaaggacgcttaacatgaaatatattttttaaaaaaacttttaagtgtacaatagagtattgttaactacaggtacaatagttttttttcttttttgacctgaaacatagtacagagttagtacacatcttgccacaatctattttattgtattggcccatagtggaagttttgattcatgtaataaaatacattttaaaattgcagtaaaagatccagggtgttaatcttctagctggtaaaaacaattacaaattctgcatttgttaatattttattggttattgccacttttccttgaattgaaaggcctaaaagatagataaattttgccaaatgctttattttgagatgtaatttttaacctcatgactgaggagagagctgaaatttctcacataaggtgcagcacaaatttgatttatgttcagtataatctcttataactcagactggaaagaaaatacacagttacgaatttgttagtgcctagagaaacaatatctttaaagtcaacaggagtggataaaaagaaaatatgtcctttgttgatattccagtaactgaccacaatgttaaatatattcgataggccaaatgtgtttaaaatttgattttggaaaagaacagaaatagacgatttaactatatagagtctaaaagtgcttaaaaaggtgtccttcgttgctttctgttaaataaaatcttggtgatttattgatgtcgttacaccatgttacacactcagcactcctcctccaatgttccccagaaaaacaaaataaatggcaaggaaaagaatctgctattcttttttggcttatcttagagcctaaacccaaagacaaagaaccctgggtcaggaggagttaaatcttaagatcctactgcctatagatatgtacctactttttgcttcttctgctaattcaatttacttcacaataaaactcacaattgatcagaggtgtggcttatgcattccagggtgccaatgacgacagggtagatgatgattctattttctaccttagacttctttgaatctgtgaatactgagttctagatgagatttctgctttgtgtcagatgggaaatccagttgtttcttgttcaaagcctggtaattccctcaacattcccccacgctctgcttattttgctgttctagtattcctctacactttgctttgtgggatttctcgtactgagaaatacagagacataaatgttgggtttgctaaaggtatcccacagatcatttgtcttccaacagtcaactggctcagtagagtaattgcatccacaatgtcttataccattcttactccaatctccaaacacatagtgagttaattaattatgatattgcccattaacactttaataaaccttatcttctctgtgaccaaccttagagttattacttccctagcattttcctcatagcatggactactatcatctgaaattgctccaacactttcaaactttcaattaatgcctgaagcatcttgtactgaatttccttgtcttaccttcaagtatattcataatttctttaattccattttatagtcatcaaggaaaatgggggtgttcgttttatgttctagtttgtctcctattagtaaatttcagtaattgcacttatttataaatctagagcatttctctgttcttggttaaatatactagctcctcaccaaacgtctctaacataataatacttttctcttgtgccaaggatatactgtattcatttcccctttcctatatgtagaggctttgttctctttttcattattgtggtaaggacacttaacatgaaatctatcctcctttaaaacttttaagtgtacaatagagtattgttaactataggcacaatgtcatacagtagatctctataacttactcatcttgtataactgaaactttatactcattgaggaacaacttcccatttctgcctggaaaccaccattctactctctgtttccatgaatttgactattttagatgcctcatgtaagtagaatcatgcagtcttgtctttctgtaactgcttcattttactcagtataatgttttccaggtccattcatattgtcacatatggcaggatttcattccttttttaagactgaatattattccattgtatgtatgtatcacatttgatttatctattgatgggtatttaggttgtttccatatcttggttattgggcaaattactggaacagatatttcttcaaagaagacatacaaatggccaacaagtatatgacaagacactcaacatcattaatcatcaggaaaatgaaaatcaaaatcacagtgaaatatcacctcagacctcttaggctggctattatatatatgaaaaagatagctgttggcaaagatgtggaaaaaatggaacccttgtacactgtcggtgggaatgtaaaattgtttagccactatgaaaaatagtatggagattccctgaaattttttaaaatagaaataccatatgatccagtgaaactacttctgggtatatatccaaagaattgagattagaatttcagatatctgcattcccatgtttattgaggcccgcttctaagaccacaaatcttccacaaataatctactttcttccttcagctcaagctatttagtagtttccagtttctacttctgaagggaaattgtccttggagcagcattatttctctttatttatttatttgagacagagtttcattcttgttgtccaggctgcagtgcaatgacgcaatttcagctcactgcaacctccacctcctgggttcaagggattctcctgccttagcctcccgagtagctattacaggcatgtgccaccacgcctggctaattttgtatttttagtagagatggggtttctccatgttggtctgtctggtctcgaactcccaacctcaggtgattcgtttgccttggcctcccaaagtgctggaattacaggcatgagccaccgcacccagacctctttatttaatatactttataatctctctagagaaaaaagtgacaaactattttcatggtgactttatctacctgatagccaaagcaacaaattcctggaatatgttcccttagtaatgtttttctggagaaatttatgttatttaatttcagttttaaaattttatctccattttaatttttttattttccatttccaaccttctttcccattcataggaaatacttataatgtgttacatacacttttgtttgttttcctgaaaaacgtgctttatattttatgtgtaagtagttttaatatacaaaactgttattgtataatatatctcattctgttttttactggttatcatgtattgcattattgttcaaagcatttgctgccctttgctgtaggaggagtatacttcccttctccattaatatcagacttgactaggggaccttgtttggccgatgaaatgtgataagtggcatgtgtcattctttggtttgtttgtttttttcatatctcgatctcaactagacgtaagatgtttcattgccagtttgaaagtaaaacgttgtatttctctttgctgctttcttaagaccaatctcatgtataattagccctatggatagtttaaacccacaaaattcacattttcctacaaaaatcacaaatgttttcctaaacttcctgtttcttcattcttcatcatgtctactcctataatttggatattgtccatgattatagttcctcattgttgaggataaatgctttcaacagtgttagattttaaaaaaaacaaaacaaagcccttaccaatgtattgtataactcttatatttagcatcttttgctgcaactttgagatttatttatcctcctatctaagcaactcctctaaatgtgtttacaactctatttcattatttcaaaaaatggtgttttcaacacatttggggtctttttaagaaaactttctgaagcatctcttacaatacctgactttcgcatttgaatgacagtttagttggatataaaattctggttacaaaatattttccttcagttaaaaaaatattgttctgttgtctgctagaatctcacatagtgttgagaaggctcattcttattttgtatttttctgtctgaaagttttgaacttttaataatttttaattttatatcttttctgtttaacaatccatgacatgagttatttcatctttctttatttctaagagttttattttgaccattacttaaaaattatccttctgtctgttattattttctgctctattgaagactataagtatctgaatattgataatgctattcaaattcctctttttctcttttagtctagcttctatttttgcatgatttcttggtacttttggaaaaattcttcattcagatcttccattgtactacattttccatctgtttttttttacactacacgtgatctaatctatttggttattgcttttaatgattataattttcttacctgatttttataatttctaaaaatatttttatgtgtatattactaatatattatcatctaaatctagcattatctgtttatttttaattacttaactgttagttggaataattctgctattgatgttgtatgctgttaactttggattttccttcaaaataaatataaatgatgttggatgttttgcttttgagttaatgttccccttaagatatcagataaatgcttcataaacagataaaggaatattccctagggagatgccaaaaacgagaaattaatttttgttaattcaatttggtctaattagaggagagtataaaatttccaggtagaaaggctaatgaaaggcaaataagctagacacaaaataatacatatatattcttccatttaaatgaaagtaagaaatgggcacaccaagtttatgatgggagaggtcattgcagcttttgaagttagcatcttctttcaactattttagaatgtaaactttgtcaaaattcaagcaaccacatataaaaagatctgttcctggattttctattatattgcactgttctgtttttctatctttatataaataacacactgttttaatcactgtagctgtgtaataaatcttgatatttgacagtgttagtgtgccagctttacttttatttttaaaattgtcttagctacttttgccctttgcattgagatatatacatgtcaatatacatatatataacatacttcttaatttacacatatgtgcacacattcacttaacaagttgctataattttgactggtattgaatttacagatgaacatttagggataattacatcttaccataatacgtcttctaattcttgaacctggactattcctccacttacttaggtcttcctcaattatttgaaatagtgttttatatttttcgtcttatagacattgcacatactatttttaatttataaatatatattggtgtggtttatgctacactcgatatcctttttagcattcctttttcatttgtctgttgctgctatgtagaaatataattaaatactatatattgacattgtgtcagtgaactttctaagttcactaattaatttcaaatatttgtacactattttgaattttatgcattcacaattatgccatcttcagttaatgagtattttgtttcttcctttctaattgctaaaattttcattctaaatatacctaatcagactgccagaactatgctgaatagaaataaatataaaatatatcttcttgtttttgttcttcaaggaaaacaattcagcttaatttcattacatatgatatatgctttagttttcccaagtaacttttttcaaaataaaaaaattgttttgtcaaaaaaaattgttttgttcttcgtttgccaatagattttatcatgaatggatatcattaattcatattgaattccattaaatgcttttttttctgaatccattatgctaatcatgtgatattccttctatttctcttttaatgtgaattgtattgattgatttttaacttgttgagatttatttagaacttagcatatgtattcatgcgagaaatgtatctgttgatttattttctttcagtgcctttgtgagggtttgttatttgggttatgtagacctcataaaatgatttgatgatatgcacctctaccaccttttgattacctggatgggtatgaataatgtttgatattagttcttacataaatgtttgagagaattaaccagcaaagccatttgacctagagttttctttgtacaaaagtctttatttacagttttaaattatgtaatagatatgaatgaagctgttctgattttgtattttttattgtgccagtcttaacaagttatgtttctgggactatttccttatacaaggaaatagtatagtttttctttttattgacataaagttgtctataaatgttcttatttcatctttaaaatctgtagaatctttatttatacccccttttcattcctgatattatttttgttccttctatttttttgttttgttgaaaaaaaagctctctttgcagtcaatgtttttattttttctgattgttctctttcactttgactttcagtagttctattataatatgcctagatgtggctttctttgtgtttgccctacttggagtgtagaatttcttgaacttgggttttgatatcattaatcagttttggaaaaaatcttagccattatcttttgcaatattgccctgcacttttctctcctctctccttcatggctctcatttgcattatactggtcattttcactgtgccccatatgtttctcatgctctttttttgtagttgtctttttttgtacttctgtttgctctctgtgtttcagtctgaatactggcaagatagtgtcaataactgcgacatctcttggtttgtttctattgtcgatcatatttttcttttggtcttttgttatacttgtaaagtttctgttaaatccaagacattgttttgagtctgttaagtttctaagtaatggtatttttttctagagttcgtttactccatataccttggtaaactaagggtcggttgatcttaaatcaaatagggactcagccaactaagccttataggttcattttacttttggttcttatctgctcttcaaaattcatcctcccacttccaaatgaaagattaggacatttactaagatccttttttccgtggtgtgttttggacatcagttgtgtcacctcagaataaagagattgttgaaacctttactacttgtcttttagaagctttcaatttagtttttctgctttttaccctgaaacagtttaataatttagcaaatgccttcaagtgaaacttgacttcacactctgccccttttttctcatgttggtctttcaagtcctgtctgtcttggcagccacatacttcaatttttgtaccttctgctttgtgagttttctaaaaagctctgttggcttttctgcctctaagcagtagcattttactagatttgcagcatcttgctccatgccaagaattggcaaatgttcctaggaaaattcaactcatagaatatttgctcacttgtttgcagttcacttcttttgagaaatttgactacttaaattctgtggggttcaattttaatctgatggaatgcctttaaaggcatatatgtttggatagatttttttccttaatctggctctttaaattttatagcagtaacattggtttttcacaagatactttatcatagtcaggagcttaattcccatcaaggcacttctgattaatttttttggctaccactcccccaggaaacagacatagtcattacattcacctttacagccttcagaggaatcgacattggaaataggcacactccctggtttttaggaaagtggtgagataaaaaacatccctggaacccctttacctgtgctcgtaaatttcttatctcagcaggtctttttcattgcccatgttatacctcagacagcagcactagtggccccactgatgtgagccatttctcagccaaagaaacatgttaaaattttcccaaggcaatgagtgtcagcaacaggagcagaatttttaaagttctttaattccacatttttctggtacagtcaacctcagtttctcatcagcttagctcctggattaaagatgaagctgggtatccttgaggaaagaccctgctaagctgccaaaaatttaaacctatactatgtctcctagccttctccaaagggacctatggcattttaccagagagattgtacacagaggaaatagaaataataagatgtttgatgattactgaacactgaactgaccctaattacaagactcaaaatgtcactgtgttctgccaatcagagtaagacccatagaagttaggtaatggaattttagctcaggtccttttcacactgggtctagttggtccccaaccacatcctgtagttatttccatacttctagaatacagaattggagtagttatactcagcaactggtagaatacaaatataagtttcctgaactgtggtgtgaggggtattatggtaggaaagcccaagtggaaaccactagaacttcttctactgaggaaaacagtatgtcagaaggaataacacattcctggagagttggcagagatgagtgccaccaatcaggactagaaggatgcaagggagatgattcccacaacaaccccattaaattcacctatttggcctatgtagaaaacagatgaatcttggaaaatgacagtggattatcatacacataggcagatggtgactccaattgcagctactgttccagatacggtttggttgcttgagcaaattaacgcatacctgatatctagtgtacagctaataacctgaaaaatgctttttttctccaaacttgctactaaagcccaccagagcagtttcctttcatttggcaagccaacaatacatcactctcctaacgcaggggtatatcaactccctggatctatgttaaagtttagtccaccttgcttacctttcccttccacaagacatcatcagactggttcactaaattgatgacattatgttaattggaccaagtaagcaagaactatcagctactatggacttattgatagggaatttgtttgtcaaatggtgggaaatacatccaacaaaaattcatgggtcttacacttcaattactaggtacttagtggtggtgacaattttgatatatcctagatttctaagtggttgtgtctggttctaccaccggaaaatgagatccaacatctagtgggcttctttggattttgggggcaacacatttttcatttggttgtgctaccacctcccatttattgcatgatgaaaaaagttgcagttttgagtggagcccagaaaaagggaaggtttggaaacaggttccaagctgctgtggaagctgctctgccacttggaccatatgattcagcagatccagtggtgcttgaagtttcagtgacaggtagagatgctgtctagagcctttggcaggtcctataggtaactcatactgcagacatctgtgagttgaagcaaagccttgccatcctctgtggatagctacttttcttctgagaaacagtttttggccttagtagaggctgaacacctagccatgggccaccaagttcccatgtgacctgagttgcccatcatgaactgagtgttgtctgacctaccaagctgtaaagttgggtgtatacagcagtactccataagcaaatggaagtggtatatatgagattgggcctgagcaggtcctgaaggcacaagtaacttacatgaagaaattgcatatatgctaatggtcttccttttgctacactgccttctgtctctcaatctccatctctggcctaatggtaaattctctacaatcaggtgacaaaggaagagaataattgagcctggtatacagatggctctgcataatacagtaggcatcacctgaaagtggacagctgcagcactacagcccctctctaagacattcccgaaggacagggaagaaaaaaaaagtgaggggaaattttgcttggaacattttatgtttcatggaaggagaaatggccagatgtgtgactgcatactgattcatggtctgtagccaagggttttattggatggtcagggacttggcaggagcatgactgaaaaattgggaactaagaaatttggggaagaggaatgtatccagacctctctgaacaggtgaaaaatgtttttaaaaagtccatttcatgtgaatgttcaccaaaggataaccttagcatagatggcttttaataattaagtggacaagattacttactctgtgtatcccagtcagcctctttatcccacctcctgtgtcattctcccatggcctcatgaacaaagtggccatgtttggcaggaatagaggttatctatgagcttagaaataaggatttccgctaaccaaggccaaacttgctatagccactgctgagcaggcaataaaccaactgtaggtaccagcaatgggtctatgatatggtaccattttctggggttggtcactagctaccttgtggcaggctaattacaatggatcacttccatcgtggaagggaaggcactttcttcttattagaagagatgttgctatggtctgaatgtttgtgtctccccaaaagttacaggctcaagcctgtcccccaaggtaatgatttaggagggggcccttttaggggttgattaggtcatgagagagagccttcacgaatggattagtgcccttatgaaagaagattaaggtatcttgttcatcctttcagccatgtgaggacacaacaagaaggcatcaccaatgaagaataggccttcatcagacatccaatctgcaggcctcttgatcttggacttcctaatctacagaattgtgagtgataaaattctgttttttataaattacccatcctaaagtatttttcttatagcaggccaaattgagacagatacttacactggatatagatttgctttatttctacacaatgcttatacccaaactactatctgtggaatacagataatgccttatccatcactatggtgttcctcaaagcgttgcttttgatcaaaatctccctttagagcaaatgaagtgcagcaatggggaacatactcataggattcactagtattactgtgttttccataatctcaaaacaagtggcttgacagaatggtggaatggccttttgaaaacccagctacaggatcaggtagacaaaattccttgcagcactggggcagcattcaccaggagtctgtatatgccctgaatcaatgttaaatatatgttggtgtttcattcatggccagatttcacaggccccaaaatcaaggggggaaaatggtagtggcaccactcattattagtgtccctaatgatgcactagcaataaatgttacttcctgtccctgaaaccttaagttctgctggtctataggtctcaatttcaaagggagacatgtttccactaagagacataagaatgattctgctgaactggaagctaagactgtcaccctactacattacacttatgcctctgagtcaacaggcaatgaagttaccttgctggctgggttgatttgtcctgattagtgagagaatgttggactgcagttacacaattgaggtaaagaaatgtaagtctggaagacaggacatacagaatctcttaggatatctcctagtactaccataccatctgattatactcaatggaaagcaataacaacccaaatcaggaaggactactaatgacccaaacccttcatgaataaagatttagggaatcccagtaggcaaagagccattaccagtttaggggcttgctgagcacaatgcaaatatggattggatagtagaaaaaagtagttataactcttagctatgatcatgtgatcagttgcaggaatgaagattgtaattattacaaattttgatgtcttatttcattatgtttgtgtgtatatataatatataccaatggttgtattgtcttcttttacccacttatcatctaacataatatattttaataatagttattgccatcgtattattttttacctattttaaacagttttaatttatgtatcataaaattaatgcatttcaatgattttaactatagtcacagaattgtgcagccattacaacagtctaatattagatttgcccaacaactgtcaatccttattcttcccttgctccagctttaggtagcccctaatctacttcctatctctacagttttaactattcaagatatttcatataaacagatttatacagtatgtgttcttttgaatctacattatttcaccgagcataatgttttgaggttcacttatgtactatacaccaatatttcacttatctttactgtcattttgttatatagatctactgcattttgtgtaaccatcattcatcaactcatggacatttgagttacttccacttcttggctacagtgaatattgctgcgctaaacactcacataaaaatctttgtgtgaacatatgttttaatttgtctgtgatgaatattttggagtgaaattgctgggtcacgtggtaactctatgtttaaatttttgaggaactgccaaactattttccaatgtgactgcaccattttacaccatcctcagcaacatatgaaggttacattttcatgacactcttgccaacacttgctatcatgtcctttttattatagccattacagtgggtagtaagtggtatttcatgtggtcttgatttgcttttccttagtggctaataatatcaagcatcttttcatgtccttaatggccatttggatatactcttttttgaaatacttattcaagttcttcacccattaaaaatatgaatctttttattattcagttgttagagttctttgtatattcaatgtatgtccctattgaatatataatttacaaatatttctccctttctgagagatgtcttttcattttcttttgttttggtgattgtgtagaacaatggaaacttttttcttttattttttcagagaaaatgattttgtttcatttatttacttaattatttttctttcccgacatttattttgtgttcagtgggtacatgtgcaggtttgttacatgggaaaattgcatcttgttattttcttgattgtacttttttgaaatgcaaacatttaattttgaataagtctatttttttttcttttactgctctgcttttggtgtcatttctaagaaataattgcctagctcaagatcagaaagaaatgtataccatggtttatcctaaagtttacagtattagctcttatgtgtaggtctgcagtctactttgtattgatttttgcataggttgtgaggttcacgttcaaattaactttttttttcatttacatgtccaactgtccccacatcatttttttcctgttcacatttattttattctttaaatttatgaggttatataaatatgcatgtattttatgcatatatacaatgatataataaaaccagggtaattagcatattcatcaccccaaacatttataatttctttttttttttttttttttgagacggagtctcactctgtcgcccaggctggagtgcagtggcatgatctcggctcactgcaagctctgcctcctgggttcacgccattctcctgcctcagcctcctgagtagctgggactacacaggcaccggctaccatgcccggctaatttttttgtatttttagtagagactttacagctccacatggctggagagacctcaaaatcatggcgggagttgaaaggcacttcttacatggcagcagcaagagaaaatgagaaagaagtaaaagtggaaacccctgataaacccatcagatcttgtgagacttattcactatcacgagaatagcatgggaaagaccagctcccatgattcaattacctccccctgggtccctcccacagcaggtagggattctgggaattcaagttggcccctccaaatctcatgtcctcacatttcaaaaccaatcactacttccccacagtcccccaaagtcttagctcattgcagctttaacccaaaactccacagtccaaaagtctcatctgagacaagataagtcccttccacctatgaacctgtaaaatcaaaagcaagctagttatctcctagatacaatagaggtacaggtattgggtacatacagctgttccaaatgggagaaattggccaaaacaaaggggttacaaagatcatgcaagtccgaaatctagcagggcaatcaaatttgaaagctccaaaatgatctcctttgactccaggtctcacatccagatcattctgatgcaagaggtaggttcccatggtcttggcagttccacccctgtggctttgcaggctacagccttcctcccagctgctttctattggctggtgctgagtgtctgcagcttttccaggcacacgtgcaagctgttggtggatctaccattctggtgtctggaggacggtggccctcttctcacagctacactaggcaatgccccagtaggaattcttggtcagggctctgaccccacatttctcttccacgctgccctagcagaggttctccatgagggccctgcccctgcagcaaactttggcctgggcatccaggcatttccatacatcttctgaaatctaggtggaggttcccaaacctcaattattggcttctctgcacccacagcctcaacaccccatggaagctgccaaggcttggggctttcactctctaaagctctctgttggctctatgttggcccctttcagacatggctggagcagctgggacacagggcaccaagtccctaggttgcacacagcacggggaccccggcccagaccatgaaactactttttcctcctgggcctctgggcctgtgatgggaggggctgctgtgaaggtctctgatgtgacctggagacattttccccatggtcttggggattaacattaggccccttgctacttatgcaaatttatgcagctggcttgaatttctcctcaaaaaatgggtttttcttttctactgcatcattaggctgcaaattttctgaacttttatgctctttcccttttaagacagaatgcttttaacagcacccaagtcacctcttgaatgcttttctgcttagaaatttcttccaccagataccctaagtcatctctctcaagttcgaagttccacaaatctctagggcagggacaaaatgcggccagtctctttgctaaaacatagtaagagtcacctttgctccagttccaaacaagttcctcatctccatctgagaccacctcagcctggaccttaatgttcatatcactatcagcatttttgtcaaagccattcaacaaatatctaggaggttttaaacttttccacatgttcctgtcttcttctgagccctccaaactgttccagcctgtgtctgttacccagttccaaagtcacttccacatttttgggtatcttttcagcaacgacccactctagtggtaccaatttactgtattagtcctttttcacgctgctaataaagacatacctgagaatgggatgaaaaagaggtttaattggacttacagttccacatggctggggagacctcagaatcatggcaggaggtgaaaggcacttcttacatggcagtggaaagagaaaatgagaaagaatcaaaagcagaaacccctgataaacccattagatctcacgagacttattcactatcatgagaatagcacaggaaagaccggcccccatgatttaattaccaccccctgggtccctcccacaacacatgggaattctgcgagatacaattcaatttgagatttggctgggcacacagccaaaccacatcatttaattaaaatttaagtattaaatagcataaagtagcctgggtgtggtggctcacatccgtaatctcagcactttgggaggccgagaagggtagattgcttgcgtccaggagttaaagatcagcctgggcaacatggtgaaaccttgtctctacaaaaaatacaaaaaaaaaaaaaaaaatagtcacatatggtggtgcaagcctatagtcccagctactctgagaggctaaggtgagagtaacacctgggcctggtaggttgaggctgcagtgagccaagatcatgccactgcagtccagcctgggtgacagagtaaggccctgtcttaaaacaaaaaataaaagtaacttaaaataattatacagcttaaaaaaaattcctgatttccactatatcttcccagtcaaacaatccaggagtcgaaaccatcaattgcttctttataaaaatctttcaatgcttaatttgaaggcaacgatagtaaagacaattttggaaaattaaaaagtagtaaaaaaagaaaatcaatcatgttcccactacctaaacacaaccattttcattttatgcacatatgtgctcagtatttttctatgtacatagatatttggcataactttaataatagtgtagataccatatgtataatatatttgtatgtatctacatacatcaccattcttattgtaaaggatgcatagaaacagtggattaggtgggagatcagagtatgggtcacactcaagaatggggagacaattaccccatgcaaaataattttcctagatcttttaaccaaaatatattatgcagatgtgacttaatgctaaatcatgtgcctgttaatgactgtttctaattttacacaatgtagattgtgctgtttgagaagtaggacttctatcagaaacccaaatgtgatgtcttaaacacagaaaagaagcctagtgtggtcagtccagggttacccttgttttccaaaacgacatcaaggacttagactttttctatctttctacctttgcccttttttacatagaagtgaaactcatgatcacaagatggctgcaggaaccccagccaccatgcttaataccaaacagccataaactgtttcttgaacaatttccaaatttccatgtttataactggtgagtgtgtttatgtattttgtatccaagtgtaattaagtaattatagctctagcagcacatatatgtgaaaagcttaaatagatatatgtatatacagacacatccacacatatataacttaactaaaaattaagcaattatgactgtagcaggacatatatatatataaatatacaattgaaaaaaaagatctctaggaacttgaccagaaaatgtgaaaggtcacattagcctaggaattcaaatgcaccattatgtataagcctttgatgatacagtcctgtatattccagtggattggaaataatgcctgcccctgatgcctgagaaaaggtactgagccccttaagacttggaagtaaaatgaagatacccaataatttatatttttgaatgttactggaattatcttccatgagaagcatttgtattgaagttatttttatgttgtaaagacaattaatcaggggctatgtgggatgaccttaaggtaatgaagaccaatatgaaatgctcagctaataatctgatacagtaatccagatatgggcaaatacaggtcagaacgacagcaatgacgagggaaaaagaaaggaagagacattattaagaggaacttcaagaacagattctttcaatatttagcaatgtctatatatggaacaaattaaataaatcaacaatgactccaagatttccagcttgtattgcctgggcaaaatgacacatagctgagcaagaatgtgcccgtatttatatttgcagttttctttaaaataaattgttaaatgtaaagaattaagtcaataattcgatatactatttataggctatatatgtaatacactttatattaaaatgatgtttaaatcttaaaagataatgagttcctactggagaataccataaaacactaccttcagctttctagagatggtaagatatagctcgccaattattttattctttcttataataataagaaaaccatgtttggaagtctaaaattaaggccaagcatgtagattttaagatattcagatgtctaagaagtgttaaggctactgttcttagtttctttactgaaaatagtataattgtcaatgatttcaaacctctaattgatgattttttttctgtttagacaataatttttttatgcagtgtgtaaatctctttaaagcccatagaggaagtgagcctgttttgacacttgcattatattccatacaatgtgttttgtgagtgaattaaggatattctacaaaatcactactaacctattgtgtagattattacataccttccaacagacattggatatttgggaaatgggagaaggggctgttttattacaatttcagtctctgtgaagtataaggttaaaaatattagggtcctttttgcaattaataattaaccagcttttggtaaaaaataatttctaaatcatgagaaatttactaaaatatatctgctttttatttgaacatttgttatagatttggattttgcaaaaagtgtaattatctttcttgaggtaataacttttaaactataacttctaaagagtgttttatgtaattagaaaaatttacaaataagttattagaaataaaaaaaattaatactcattcaaaagaagcaaagactattcaataaaatgagaatagcaatcaccctgaaaggacacaatcaatcacacacgaactggtaatgttacatagttaaaatatgcactcttagaaaacccaaacagaattccattttaacacagtagatttttatattacatcattttgtttcaaagtttatatatttgctctttgatctgtgtgctatttagatgaatagataattgttttcaggggataatgacattttttgatgctttgcttttgttttgacatttgatattttgtggtctgaaaatatggcttataaaaatgtctctttaggtagaatgctttaatgttttgttgcgagttctatacaaatggatactccattagaggttaaaaactttcattcttacagacaatctctcttctcactctcttcttctgcctttttctctttctctctcagaaaaaaaaaaattatgtaatattatttaaatcccaaggaatcatattagtcttttgacttaaaatactaaaatattttactgtgatgattctagtattttggtattgtctaggagttttgctatatgtattttcttgcttttttgtttggtgcataaaaaatatgagtttttaaattatccattggttattaattttattattatagaaatgttcattagtgttctattgatgctttcacaaattaccaaaaactcaggggctaaaaatgatgcacatttattatactatatttctgtagattagaaatcttacacaagtgtcactggacttcaatcaaatgttttccttcctggataccctaagggaaaataagtttctctgacttttacaacttccagaagccactcacaaattcattcactcatggcccttgcctccatcttcaaaatgagtatcattgcaggtctctaatccttttgccatcatatcttttgaccacagccaggaggggttctctgcttttaaaggttcataattaggttgaaacttattggataatccaagataatctctccttctccagtccttaacttcagtcacatttgcaaagtctcctttacagtgtgatatgacatattcacagattacagggattaggaaatgcacatcctagagttctaatcaatgattttggttctcaccttgaatgttgccttttgtgaaatgaattctgtcttatatgatatgaatattgcctcttgtgattgacatttgttcttgtatgtcaagtaaatcatatttcaccctttcatttttcaacatctgtgttaactttctaaagtgatttttttttgggctagatatttgccagaggtttttttcacctcaaattcggtatttgataggaggaattcgtctattctactttattgtgataactgatatagttaattttattttcttcattttattttaggtattccatctatttttttgtttactaatacaagagaaagacagtcaccttctaactgttctcactagggtcatttaattcattaggattaaatttttgtggggctacctatatttttatgataaaatgatatattcaaggattgcatgtagcaagtatcactgcctatggatccttgtacattgaaactctgggcctctggaataggtgtgaatctgcactcatgaccccgggtgcaacaacaatttcctataaacgttaacaataagcaaattttggttgttgagactcttgagccaaggagttgagaacagaaacagattaagtagtacatgtatttatgccaccatatcccaaaatcccatttctagatttactctttatccaagcaaaatcaggctctgtctcaacttcctgtgctaaacgcaatggatatttttctgtgattatgttaatgaacttttttggcctcatctggaattgttaactatttccaccttcttgaaaatccttcttcacttgcttttcacaaggttatatttcctctttataagtttttctgtcacgtctgtattctgttatagttcctttccgtggctattacttacatataaatatttattaaacttatcactagatctatttcttactccatatatattatttggttagccttatcttctcccatgttttcaaaaccagaattatctggacttggtgattgtgtagatacaaaggttaaggaaggatagagagttaagatgacacctgagattcttgattggacattttagttaattcctattagaatgacagcatacaaaacaggtttgtaagaaaataattattcagctttgatcatagtgagtttgaggtgcctgttattcaaattaaaaatagtcctcaattgagtatacagtcctaattagcaggagatattctatggatgtatgtctttggcattcatctcacttgtgaaataattgaagtcatgagactaggtgagaatgttatagaggagtctgtggagtaggggcatgaaaagagaacaaaagccagagttctaaaaaacatcaacgtttaagagttagatagaagagagtatcacaaaatgactgactataagcacttagataaatgtgagaaagctcaggaggagaatgtgatataatacaaacaaaggaaatatatgactgatggacagagttgattgctcaactaagtcattccctccttctacataatttatagaatctaaagcatattccatcagctttatgcccagggaggggagaaaataccttcagcccacagagtatgaattatgattggcctaaataaaatatgctaatctcaacttctttgctggtggctattttatatattggcttatgacaaagtgctagccaatgagaagtcagggaaaatcttgggtattctgagaaaagaccaatgttctatgacatgtactagtggcacttctcttttttagccaaacattttatacttaataaacactttgactacagaaaattaggtggtacaagctataattcttaaaatgtagatttttgatgagtaagagaggaaaactgggggcaagcactgactcaattatctcaggctggggaatttgttaccctttttatataaagcataacacatggtcaatttttcttttgttgtattctgtgatgtagactacatttcaaatgataaaataaaattagaagtggtaggggaattccagggtgttgtcgtgagttgtccctttcttagagttcacagaagaaagagtagcacttgggtaaaatatgagtagtctaaaacaggagtgtgaaataagtaagagagatgctgtctgtctctacgtagtaataaattaaataagcaggaggccattagcttgagctgtctccataatttgagtttctacataacaaactaaaacctaacttaaaagtgtattatttttgtgtaccaaatagccaggttttagccaataacaaacaggaaagcttcagccaatcacaggcagccattaccatccaggagcacgggaaattctggaaatcaaaggaagaaaagtggacctccttctggacactggggctggtctctcagttctcctttccaatccaggctccctctcctctcttagcatgaccaagaggggcatctcaggaaggcctttaacctgatatttttcccaaccctttagttgtagttggggagatctcttgttcgcccatgcctttctaattatgcctgaaagcccaactcctctgttgggcagggttattctggcccatataaggaccaccaccctgatggctccaggacaaactctttgtctccctttagtggagactggtattaacagaagtttgttcaattcaaggaaaaattggctgagcaagaacttccataccagttcagatccaccttaaggattccacttccttttctaaccagaaacaatatcctctgaaaccagaagttaggaaaggactacaagctgtcattgataaattaaggttgcaaggcctcaaaccctgccacagcccttgtaataccccaatactgggagtccgaaaacccaactgggaatggagaatagttcaggacctctgcctcattaatgaggctgtggttccaattcacccggtggttcccaatccatataccctactaactcagatacctgagggaactaaatggttcacagtcctggacctaaaggatgccttcttctgcataccactatacccctattcctagtatttgtttgcatttgaggttccctctaaccaaaccacccagttaacctggatgttgttacctcagggattccaagacagcccccacttgttcgggcaggaattttcaagtgacttctccgagtttctttatcctgaggttaaagttttacaaatgtagatgacattctcctcagtgctccaactgaagaaatctctcaggagggcagtaagactcttagttttctggctaacagaggatgtaaggtttcaaaatctaaagctcaactctgtaagacttcagtgaagcacctcggcctggtattgtcagaggggaccagggcattgggcaaagaaaggattaagcccatctcctctttccccttcccccaaactctcaagcaactgaggggattcttaggcattacaggattctgcagactatgcatagctgggtacagtgaaatagctcatccctcgtatcacctaataaaggagactcaggcagctaaaactcactggataatttgggaactggaggctagaaggccttggaccaactaaaacaaggcttgcttaaggcaccagcccttagtttccccatagggaagagatttaatctttatgcatcagaaaggaaggaaatggccctgggagttcgaacccaggccattgatacctgaggaggcagttgtctgttagccacagactccccttagaaaacagcagtccagccacattatgtagagtataaaaggtagcctgtaggctacctaaagagcttgagttggtagccaaaggatggccagtatgcctccgggcagttgcagcggtagccttgttggtaccagagactactaagttaaccatggagactaacttaactgttaacactctgcataatgtggcaggactgctgtcttctaaggggagtctctagctaacagatgatgacctcctcaggtatcaacctctgctattagagggatctgcagtcccattcagaacctgtccctccctaaatccagccaccttcctcccagaggaagctgaggagcttgaacatgactagaaacagatagtagtatgaacctaggtggccagagaggacctcaaggaaaccccgttagagaacccagactggattctttttataaacagaagttcttttgtaaaacaaggaatccataaagcagggcgtgcaatagttactctgaatgatattgttgagagtgcatctctctcctcaggcatgagtgctcaactagccaaactaattgtcctcacaagggcactcgaattcagcaaaggaaaagcagttaacattcataccaattctaagtatgctttcctagttctccatgcccatgccacttctggaaaacagtcaaaagtttaaagccaccaagttaacatattatcaatcaatagacaactcaataatggtagaaaactttgtggcattttatttgccctgtgtccaactccgtccatggctcagcagtgatatagaagacagcagtccataatcccagtgtgagattatggttcctggttctagaaagagcagaatagaacttatttacaatttttttttaatttttaatttttgcgggtacatagtaggcatatatatttatagggtacaatgagatattaggtatgcaatgcataataatcacatcatgacaaatgggttattaatcctctcaagcctttatcctttatgttacacacaatccaattttactgttttagttattttaatatgtacaattaaattataacttagtatagttaccctgttgtgctatcaaatattagatcttattcattctttctatttttttcacaaataattttgtgtgctgtaacctgtctggaatctaccttcaggattgacacaaggtgcttgcctttgttttgcctaactcagaactcatacaacagtagaaaatggtggacattcctcaaaaacattgtaaggcaaatgaacaaccctggggcaaaatattatggttgaagcatacaatagagcaactaaagactgagaggaaaagacaggatgtttatttgagaaattaggcattcaaaagtgctcatgtataggagataatttgcccaaggcagggtacatactcagaaaagacctgagaatgccctatactttcaactctcattaacctataggttcagtgtaagtaggaagtgaagggaaaagccatgttgtaaatgtcctggctaaacattgaaggagcatctcagcacaaatacaatctgaaatattgggagagggcattaatgaaaaacctatagtacacctcatagtcaatggtgaaaaacacaaagcttttcttcttagataagaacaaaaaaaatgcctgctttcataacatactttgtatggaagataatttccaaagcaaatagaaaaaaaattaaaagaaacaaaagacatctaatttgtaaaggtataagtaatatcatattaacagaatatataatcctatctatggaatattgcagagtccatcaaaaaagagagaaaacgccttgagttaatacacaactttggcaaagttgtagcttacaacagcaacccagaaaagtcaattgtgtctctatacactagcaatgaataatgcaaaaagtaagttaagaaatcaaataatttacaatatcatctaaaacaataaagaacctagagaaaaggttagacaaacaggtgatggatttgtacattgaaatctacaaaacattgattaaaaaattaaagaagacttaagtaagtgaaaaaatattctatgttcacggattagaacactacccaaaatgatcaatacattcaagataatccctattcaaagtacagtgacttttgggagaaacaaagaagccagttctcaaattcatataaaattacacggggtcccaaatgtcaaaacagtctttaaaaaagaaggacaaatttggaggactcaaacttcccaatttcaaaactaatttcaaagctagtaatcaaagtagtgtgacagtagcagaaagacagacatgtagaaaaatggaaaagaaccgggaatctagaacaaaggcctacatctatagtcaataaattttaacagggatgccaagatgattcagtcgggaaaaataatttttaaaataaacaatactgaggctaatgcatatctacattcaaaggaatagatttttacacctgtgttacacaatatataaaacttaattcaaaatggataaatgactttaatataggttttcagatcaattgacatatagtttttcataatattctgtaataatattttaaatttctgtgctattagttgtaatgtctactttttcatctctatttttatttacttagctcttctctcttttttcttagtttacattaattagttatcagatgttatttgcaatcctcacataaccaaaaaacaaaaatctataacagatacacaaaaaataaagagtaagaaattatatcatatcaccagaggcaatcacttttatgcaaaggaagacaggaaagaagtaaagagaggaccaacaaaacaaccagaaatcaaataacaagatggcagtagtaagtccttacttaccaataattaacattgcatgtaaaagtactaaatttccagtgaaaagacagagtgggtgcatggattgaaaaagaagacctaattctgtgcttcctacaagaaactaatttcacctataaagacccaggaagaatgaaaataaaatgatgaaaaaagatagtctatgaaaatggaaaccaaaaaagaataggaatagctatatttatatcagccaaaatggagtccaagacaaaaattatataaacagacaaaaaggtcattatataaagacaaagtggtcagttcagcaagaagatacaacagttgtaaatatatgtgtacccaaccctgggggactgagatatatgaagcaaatattatcagagcaaaagagagaaatagacaccaatacaataatagctggggacttcaacaccccactttcagaactggacacataatatagacaaaacaattaacaaagaaacactggacttaacctgtgctatagactaaatagacctaacagacatttacagaacatgcatccaaaaaccgcagaatacacattcttctcctcagcagcacatggaacattctcaaggatagaccatattttaggccataaacaaggcttaaagattcaaaaaaatttaattatgtctagtgttttttactgactaaaacggaataaaactagaaattaacgacaggaagaattctggaaactataaaaacacatagaaattaaacaatatactcctgaacaatgattgggtaaaaggtgatattaagaagaaaattttaaaagttcttgcaaaaaatgaaaatggaaatatcacataaaaaaacctatgcaaaagctgtaccaaaagggaaacatacagcaatgcccacatcaaaaaagtagaaaaattttaaataaactactgatgcatcttaaagacatataccagaaagagcaaacgaagctcaaaattagtagaagaaaagtaaaggacagagcagaaataaatatgattgaaaataaaaaaatatgaaagattaatgaaacgaagagttttttaaaagataaaatcaacacaccattaaccagcctaattaagaaaaaagagagaagatccaaaaaaataacatcagagataaaaaaaagagacattacaactgacagcacagaaacttaaaggattattaaagaatattatgagaaaccatgtgccaatagatcagaaaacctagaagaaataataaattactggacacataaaacctactaaaattgaaccatgaagaaatccaaaacctcaatacaaaaataacaagtaatgagataaaacagcaataaaaagtctcccagtacagataagcccaggacctgatgacttcacactaaattctaccaaacatttaaagaactaatacgaacccctacacaagctatttcaaaactgtgaggagaaggaaatatttctaaacttattccataaggccagtgttatgctgataccaaaaccaggcaaaggaaaatgaaaggccaatatatctcatgaacagagatgcagaaatcctcaacaaaatactaaaaaaccaaattcagtaacacataaaaaagatcaacattatcaaatgggattcatcccagggatgcaagtgtggctcaacatgaacaaatcaataaatgtgatacaacatattaacaaactgaaggacaaacatcatatgatcatttaaatagatcctgaaaaacaatttgagcaacttcaatatcctttcataataaaaactctcaacaaactcggtatagaaggaacatacgtcaacatatgagaaaagccatatatgacaaacccaaagttagtttcataatgaaaaaggaaaacttgaaagtgattctgtaagttctggaatgcaataagggtgaccatttttaccacttttattcaacatagtactagaagtcctagccagagaaattagacaagagaaagaaataaaggagatccatattggaaatgaaaaagctaaattatctttgtttgcataggctataatcttatatttagagaaaactaaaaattccaccaaaaaaactattagaactgataaatttaggaaagttgcagaatacaaaaccaatgtacagaaatcagtagcattgtgatatgccaaaagtgaacaatctgaaaaagaagccaggagagtaatcctatttatggtagctacaaataaaataaaatatctaggaataaacttagccaaagaagtgaaagatctctatagtgaaaactgtcaaacgttaatgaaagaaattgaagaggacacaaggaaatgaaaagatagtcagtttgcatacattagaagaatcaacactgttaaaatgtacatactacgcaaagcaatcttcagattcaatgaaatccttatgaaaatatctatgacattttctacagaaataggaaaaaaaaatgccagaatttatatggaactacaaaaaattcagaatagccaaagccaccctgatcaaaaagaacaaagctggaggaataatattacctgacttcaagttacgctacaaagctgtagtaacccaaatagcatggtactggcatcaaaagagacacatagaccaatggaacagaatagagaacccagaaataaatccatacattgacagtgaactcattttcgacaaacttgccaagaatctagactcagagcaattagacaagggaaagaaataaacggcatccaaattggaaaagagaaagtcaaactatctctgtttgcagatgatatgcttatttacctagaaaatcctaaaaactcctccaaaagactcttagatttgataaatgaattcagcaaagtctgtgattacaaaaagaatgtacacaaatcagtagcactgctatgcaccagcaatgaccaacctgagaatcaaagcaagaacacaatcccttttacaacagctgcaaaataaaattaaattaaattaaaataaaataaaataaataaatacctagtaatacactaaatgaaggatgtgaaagagctctacaaggagaactacaaaacactgctgaaataaatcatagataacacaaacaaatggaaacgcatcccatgctcatggattggaagaattgtgtctggaattggttccttctggtgggttcttggtctggctgacttcaagaatgaagccgcggacccttgcggtgagtgttacagttcttaaagatgatgtgtctggagtttgttccttcagatgttcagatgtgtctggagtttcttccttccagtgggtttgtggtctcgcttgacttcaggagtgaagccgcagaccttcccagtgagtgttacagctcttaaaggtggcacgtctggagttgtttgttcctccctgtgggtttatggtctcgctgacttcaggagtgaagctgcagaccttcgcggtgagtgttacagctcataaaggtagtgtggacccaaagagtgagcagcagcaagacttattctgaagagcaaaagaactggaaggggacccgaggaggttgccgctactggctggggtggccagcgtttattcccttatttggctccatccacatcctgctgattggtccattttacagagcgctgattggtccattttacagagtgctgattggtccgtttttacagagtgctgattggtgcatttacaaacttttagctaggcacagagcgctgattggtgtgtttttacagagtgctgattggtgcgtttacaaacctttagctagacagaaaagttctccaagtccccacccaacccagaagcccagccagcttcacctctcaggatcaatattgtgaaaacaaccataaccatccaaagcaatctacagatttgatgcaattcccatcaacataccagcatcgtttttcacagaattataaagaacaatcctgaagttcatatggaaccaaaaaagaggccaaatagccaaagcaatcctgagcaaaaataacaaatctggaggcatcacattactggacttcaaattatactacaaggttatattttccaaaacagcagggtaatgatataaaagtaggcatatagaccaatggaacagaatagattacccagaaataaatcgaagtatgtacagccaactcatctttgacaaagcatacaaaaatattaattgggggaatggacaccttatttaataaatggtactggaaaagctggcaagtcacatgtagaagaataaaactggatcactatctgtcaccttatacaaaaatcagttcaggatggatcaaagacttaaatataacacctgaaacaataaaaattctagaagaaaatattcgaaaaactcttccagacatcagcctaggcaaagaattcatgcctaaggccccaaaagcaaatgcaacaaaaacaaaaataaataaatgagacccaattaaactaaaaaagcctcttcatagcaaaggaaacaataatcaagtaaacacacaattcacagagtgggagaaaatatttgtaaattacagatctggcaaagaactactacccagaatttacaaggaactcaaatcagcaagaaaaaataataataataatcctatcaaaaaatggccaaagaacatgaacagacatttctcaaaagaagagacacaaatgttcaacaaacacatgaaaaaatgctcaacatcactaatcataagggagctgaaacttaaaaccacaataagacatcaccttactcctacaagaatggccattatttaaaagtcaaaaaataatagatgttggcatggatgtggggaaatgagaatgcttatatacactgctggtgggaatgtaaattagcacaacctctatggaaaatggtatggagattccttaaggagctaaaagtagatcgatgatttgatccagccatctcactactgggtatctacacaaagaaagaaaaaaagtcactatatgaaaaggacacttgaacatgtatgtttatagcagcacaattcacaattgcgaagatgtggaaccaatctaagtacccactgactcatgaattgataaagaaaatgtgttatatatacaccatggaatactgctaagccattaaaaaggaacgaaacaatgtattttgcagcaacttgaatggagctggggggcattattccaagtgaaataacacaggagtgaaaaatcaaaaattgtatgttgtcacttataagtaaaagctaagctatgagtatgcaaaggtaaacagagtgatataatgaactttagagactagaagaaggtgagtgggaggagggcttgggaaaaaacactacacattaggtgtgatgtacgcttctcaggtgacaggtgcacgaaaatatcagaatctactactagataattcatccatgtaactagaaactacttgtgcccccaaagctattgaaatataattaataaaaaacaaacaaaaactgcaagttaaaattgattaattcactattagagacttcagcaacactctatcagtaattgacagatatagcaggcagaaaatcagtacaaacatagacagcccaagccattaactggatctaattgacatagaacaccttcattcaaaaacagcagaagacatagtcttctcgagctcacataggacgttcaacaaaatagacaatattctgtaatataaaacacaccataattttaaaaaatagaaatgataaaagtatgctgtcacaatataatggaattaagctgaataataatataatggaattaagctaaataataacagaaagatagctgtaaaatcccaaaatcattggagattaaacaacatacttctaaatagtatgtgtctcaaaaaagtctcaaaggaatttaaaagcatttggtactaaatgaaaatgaaaatactacctatcaaactttgtgtgatagagtgaatatagaataaggtgacatttgtagcattgaatgcatactttagaaaacaggaatatctaaattcaacattctaaactcctattttaggaaactatataaagaagagcaatataaacctcaatcaagcagaagaaaagaaaataacaaaagaaattagagcagaaatcagtgaaatactaaacaggaaatcaatggagaaattcaaatgaaaacaaaagctggatctttgaaaagattaaaaaaaattttttaaactcaaatcaggctaaccattaggaaaaaaaaggcaggaattgaaaataccagaaaggaaaaagagaacatcattgctgatcccacagtcattaaaaagataacaaaaaatattatgaaaaagtctatgcccgcatatttgaaaacttaagaatgaaattataccaattttctacaatctgtgacggaaaatagaaaaaaaataataataacttttctaactagatctagataggtttactggtgatttctaccaaatgtttaaggatgaaattataccaattttctaaaatctgtgccagaaaatagaaaaaaaagggaatatttcctaactcttaactcatcctataaggctagcacctccctaataccgaaattagataaagaaataacaggaagggaaaactacaaaccaatatccctaatgaacatagctgcaaaaactcacaatatactattaggaaatcaacaccaacaatgtataaagtaattgtacattaagtgaaattatttcagatatgcaaggctggttcaacatttgaaaaattaatgtaaataacatatcccatcaacagcgtaagaagaaaaatcatatgaccataacaatagatagagaaacagaatttaacaatatccaacactggtttattacaaaaactctcagaaacctgaatacaggagaaattcctcaacttcataaagaaacctgcaaaaaataatgtcgggaatgttactgtagataaaatttatataataatgtagggaatgttaatggtgagaaactagattctccatattatttcttcatattactgggaaaaaggcagtgaaaccctcgctcacaactactattcaacatggtattggaagtcctagctagtgcaataagacaaaaaaatgaaaatgaaagatacatagattgggaagaagaaataaaactgttatttacacagctggtgtgatcttctattcagaaaacccctaagaatagaccaagaaaagccctaaactaatgagcaattttagcaaggttgcaggatacgaggttaataaactaagtagttaataaactacttttctgtatattatcaaggaagatacattaaactagataaatttgtattgactagtgacaaatttatagccattttaaagcttacagggtatgtcctaacacatttttttaaactatggttactaaaacaaagaatagatcaaaacaaagaaaccggagctcaaaaagattcagaaaatttactgcaatagagaccagaaacattgaaacccattggctgactcttgtattcttaggcccaaaccctgggcaccaggaatctcatggcagatattctgcaatatcccaaaaaggcattcccccaatgaccatattaattatggatatcgaagacaatgaatgagaaagttcagtccataaaatggaactacattctgatagattggctatccagagggcttctccactgaaggcagaaaatcaatactaatcctttctagcaggctatgctatatattacagagaaaaagctactgtgaattccttcctcttccccttaaataaagttgttgcattccttctccatcattttataatgaatatattgggggcaggtaatttatctttttgatatagaggcgccacatttggacttaatgaataagaggatagatcaaacatttaattcaagctggatttggtaattagatgagcctaagagaatgtctctctttgaaagaatataaatgcactgaaaaaaagtaaataaatttaatatgtatatattggggaaagcaccagtatgaatattgaactaggaattaaaaaggcatgtcacgtttggtgacttcccaatagtccatcagcctcctttcttcctcaatttatagaaatccaatttgttcaagtagcaatgtgtgtgtgttcgttctccaagccttagggaagccatatttaatataaaccaagcaaaataatcccagtactattttgtgagggcttttttttttttttttcttttgagacagagtctcgctctgtggctaggctggagtgcagtggtgcgatctcggctcactgcaacctccgcctcccgggttcaagcaattctcctgcctcagcctcctgagtagctgggactgcaggcgagcatcaccacgcccagctaatttttgtacttttagtagagacggggtttcaccatgttggccagaatggtctcgatctcttgacctcgtgattcggcctcccaaagtgctgggattacaggtgtgagccaccatgccgggcctgttttgtttgtttgtttgtttgtttttgtttttctttgaggtggataagtaactcacttatgtctcgagccatagggtcaaggatacagtggatttagaaaaaaataacacacctttttcctttaaccaaaatttattttagagaagatggtacttggagatgtttcagtcatgtttaaatcatgagcgtataaaactaacaaaaataagccaagtgtggcattgaagatatgtagaaaaagcttagctatttgttgtcattgctgaggctttttgccagatatggaatcattcaattttcttattatattaattaaatgcctttattatggagttttgttatctctttttttaaattaggatataagttactctgctataacaaagagaactaaaaatatagaaactcataccaggtgaggttttatttctctacatgtaatagttcagcaatgcatgggctattcagggtgagtgggctgctgggtctacaatgccgtgaaggaaacgaggcttattctatcttatttctttgctacctctccacctccacccgcaatggtgttgccctcatcagcatgatcagcattaacattatgaccacattgatattctagcctttaaaaaagggaaaatggagagaaaacaattttatttttaaaataatgtgagcagaatgttgcacacattctttctactcaccctccagtagcagaaattcaaatggccacacctagcttcatgggattctaggacatgaaacttctagttgggagttcatgccctgctaaaaccttgggtaaacagttgggtttacattgctcaaaagacaaacaaaaacaaaaacaaaacaaaacaaaacaaaaaaacaaaaaaaaaatagttttttttctacacttgtagcaattgaaacactttaagaaataactgatctgaacggtcaaatatttctgagatttcaacaagataaacaatgataattatttttaatgtttatctttaagaagttctggctgggcatggtggcttatgcctgtaattccagaaatttgggaggccaaagcaggtggatcacttgcggtcaggagtttgagaccagactggccaacatggtgaagccctgtctctgctaaaaatattaggttggtgccatttggcaaaaaacgcaattactgttgcaccaaccaaatacaaaaattagcctggtgtggtggcatgtgcctgtagtcccagctacttggcaagctgaggcaggaggatcacttgaacctggaaggtggaaatttcagtgagctgatatcatgccactgcactccagcctaggcaacagagcaagactgtcaaaaacaaaaaaacaaacaaaaccataaaacagccgggcacggtggctcatgcctgtaatcccagcactttgggaggctgaagcaggcggatcacctgaggtcgggagttcgataccagactgaccaacatggagaaacccgtctcttctaaaaatacaaaattagctgggtgtggtggcacatgcctgtaatcccagctactcgagaggctgaagcaggagaatcgcttgaacccaggaggtggaggttgtggtgagccgagatcgcgccactgcactcctgggcaacaagagtgaaactctgtcttaaaaaacaaaacaaaacaaaaacaaaaacaaaaacaaacaaaaaaacagaaaaaaaaacccaggatttctttactttggaaaaaagtgggttcaaaaacataccatagaggaagccagactgcaggaattgaacacaaacgattatataaataatgttggtaaggaaagtgtggaaaaatatataggcctgtaaatttaagactaccattttaaagctgaaatgaatgagcatatcccaacattggtaggtagaacaacaaaaattaatatggtgaattatatcatcagatattcaaatgttaaactaactacgtgttctttcactaaacactggctaataatgagctttcttcttccctttcatatattgattgatggtgataatattttgctggatatttttcatttattacaatgaatttgtcagatttgggaatcatagctttgctagcatcgtaaagtaagttggaaaatattcctgctttctctatttttaaaataattcctttaagagtcaagtgtttcttaattaagtaatagaattatcaaagcaagtcatttgaacttgaaacttctatgtaagaaggttaattatagatattgcacaatttatatcatattttgtttctttacatcaaaatttaaaaataaattccataaatttaattatagcctttagtgtcattaacatctgtatgacatgtactattccccccttttcactcctgatattggaagtttgtactttttttgttgtaccttgattaatttccccaaggagttatgaattttaaaaaccaacttttacttttgttgattttctctgttccatattgttttctactctattaattttggctcacttctaacttatttctgtaaaatttgtttcttaatcccacagatgatagataatacactcagtatgattcccaacctatgaagttttttgaaacttgctatatagccgagcatataaatgctgcaactttagaaatgtgcactttattaacatttactttctacaggttccctgtactgtgttttatacatttaaagttaaagtttgatcattgttattttgtgtatttttactgactttttttctgacaagcactaagagacatctatcaaaatcctccaatttgaatgtgaacttctcaatttatctttatttttatgtcattttatttctttatacatgcttggatatgtaattcagagcatacaagttaaggatagttatatattcctagttgattgactcttttatcattatgggatttttttcattataattagtattaattcttgttttttaatagttttttatttttaatttttatgggtacataataggtgagtatatttatggtgtacattagatactttgatacaatcatgcaatgcataataatcacatcatagagagtgaagtatccatcctctcaagcatttctcctttgtgttataaagaattcaatttcactcttttagttactttaacatgtataattaagttatcattgactatagtcaccctgttgtgctatccaatagtaggtcttattcattcttagtaataattattgatgttagacaattttttctgaaatctgtatagctacattgtttcttgttttgtttttatcatataaatccattatcatttaattaaaaatacattatcttccttatatttaatttttttctcttttaagcagcatgcacttagaattttcttcagtcttaatatctttgtctttaaattggaagagttagatcttttttaatttgaagtaattattgatttatttgtacttgaatccaccagcaaacttttctatttgtcccattttctatgctcttttttttgctattttcttgacttatttttagtgaatcaataattgaatcatttcatctttgattagattattttaaaatacttttaatagttatgctggagattataacaggtcttatagatttattaatgtctaacataaatttttaattttaacacctcccaaatgatgcaaggaccttcaacacttaaaagtaatgtaggctcctttatttttgtattgttttttctgaatattaattctgcatatacttaaaacttatgtaccatatatattattgcattacatatttaatatacttttagattcacccacatatttatccttttcatggttctttattccgtttcataattttgtgttttgaactgctacaattttttattggttttatctaatgatctcactttggaattgctttttgcatagaggttactggagagaattatctcagtattttttttttccttttcacatagaaacatttatttcacctgtatttttggaggatatttttattggttatataattctaagctgccaattattaatgcttaccactttaaagctgtcaagttattatcttctagcatccaatttttctgataagaagtcatctttaaatttgattgttatgccttaggaggccacgtgttgattaactttggccattaagaggtttctattcacctttgattttcaggattttattataaattgtctagtttgggggttgcttgtttttgtttgtttgtgtttttgttttttctttgttttgtttttgtttgtttgtttttgttttttggcttggagctcttagagattttccaatcagtgacttgacaaacttattcatttgttatatctcttcaaatactgtttctgtgttattctggtgctccaatgacccaaatgtaactttttattattttcccaccagtacttttcaaatttaaaaaaaatatatatttttttaatttttaattcttgtaagtacatagtgtttatatttatggggtatataagatattttgatacaggcattcaataatcacatcagggtaaatgggacatccatctccctcaagcatttattctttattggtgctataaacaatccaattatattctttaagttatttttttaatgttcaagaaattattgttgactgtagtcattctgtcatactatcaaagactagatcttcttttttttttttttttttttttttgggcagagcctctctctgtctcccaggctggaatgcagtggcgtgatctccactcaccgcaacctctacctcctggactcaagcaattctcccacctcagattcttaagtagctgggactataggtgcacaccaccatgcctggctaattttgtattttttgtagtgatgggtttcctcatgttgtccaagttggtctccacctcctgggctcaagtaatccacccgcctcagtttcccagaatgctgggagtacaggcacaagacactgcacccagccaaatactagctcttattcattctagctatcattttgtactgattaaccatcccattttcccccagtaccccactatcattcccggaatatggtaaccatgcttctaaactctatctccatgagttcaatcattttaattttcaacctcacaaatacatgagaacatgcaaagtttgtctttctgtgcctggcttatttcacttaacatatgacttccggttccatgcatattgctacaaatgacaggatcttgttccttattatagctgaatagtacttcgttgtgtatatgtacacattttctttatcgttcatctattgatgtacactaaggttgattccaagtcttggctattgtgtagagtgctgcagtaaacatgggagtgcagatatctcttagatatatgatttcctttcttttgcatagtatactgagaagtgggatcgctggatcaatggcagctatattattagtttattgaggaaacttcaaacttttcttcatagtggttgtaataattacattctcaccaacagtgtacaagggttttcatttctccacatcctagccagtatttgttattgcctgtcttttggatataagccattttaaccgggggtgaaatgatatctcattgaagttttgatttgcatttctctgatgatcaacaatgttgagcaccttttcatatatctatttgacatttgtatgtattcttttgagaaatatctactcatattttccccatttttaatcttttttgagatttttttttcagtagagttgtttgaggtgtgtagatttgttctcgggttttccattctgtcgcattggtctatgtgtctgtttttatgccagtaccctgctgttttggttactatagctctctagcataatttaaagacaagtaatgagattcctccagtttaatttcttttgcttaggatagctttggctattctggaatttttgtagttacatttaaattataggattgttttctctatttctgtgaagaatgccatctgtaatgttgtagggattgcattaaatctgtagattgtattggataatatggatattttaacaatagtgattcttccactctatgaacatggaatacctttccctttttgtttcttcttcaatttcttgcattaaagttttgtagttttcattgtagagatgtttcacttctttggctagtttaattcctaggtattttattttacttccagctattgtaaatggaattacttttttatttctttttcacattgttaactgttggcatagagaaatgatactgatttttgtatgttgattttgtatcctgcaactttactgaatttgtttataagttcccgtagttttcctgtagagtcttgaggtttttccaaatataagattatgtcatcagcaaacagggtaatttggcttcttcctttcctatgtggatgctctttaaatctttctcttgtctgattgtgctagttcggacttccagtaatatgttgaataacagtggtaaaagtgggcatccttgttttattccagatcttagaggaaagggtttcagtttttcactacttggcatgatactaactgtgggtctgtcatatatggcttttattatgttgaggtatgttccttctgtcaccatttttttagggttttttttttttttttttttttttttttttgagacggagtctggctctgttgcccaggctggagtgcagggtttttaccatgaataggtgttgaattttatcaaatgctttttcagcatcagttgaaatgatcacatggtttatatccttctttctgttgatatgatgtatcacattgactgatttgcatatgttgacccatccttgcatcccagggctaaatcccacttgatcgtgttgaatgattttttaaatgtgttgttgaattcagtttgctagtattttgttgaggatcgctgcatcaatacacatcagtgatattggcctatagttttctttttttgatgtgtccttgtctggtttagtatcagggtaatactgacctcacagaatgagtttgagagtattccctcctccttcatttttcagaatactctaagtagtattggtaatagttcttctttaaatgtttggtgaaattcagcagtgaaaccattgggtccctagcttttgtttggtgtggaaaacttttattacaacttctatctcattatttattattagtctgttcaggttttggatttcttcctggatcaatcaagataggttgtaaatatctgggaatttatacatttcttctgtgttttccaatttattggcatatagttactcatagtagccactaataatccgtttagtttctgtggtatcagttgtaatgtctcctttttcatctctaattttatttatttagatctctcttttttattagtctggctaaagttgtgtcaattttctttatctttgtaagaaaccaactttttctttcattaatcttttctaatttttagtctcaaattttatgtatttctactgtgattttcactttcttctacttaattttgggtttggtttgctctttctcgtatatttctttaagatgcataattcatttgtttatttaaaatttttctccttttatgatgtaggcatttattgccatacatttccctcttggtagagcttttgcataggttgttgtgtgttgtgttttcatttttatttttccaataaattttacaattttattcttaacatcttcattgacccaatcatcattcaggagcattttgtttatttcctatgtgtttttatagtttccaaaattcctttggttattgatttctagctttattgtggtcagaaaaatatttgacataaatacaatatttttgcaatttttgagatcttttttttgtggcctaacatatggtctatccttgagaatgtttcatgtgctgaggagaagaatgtgtaatctgaaacctttgggtgcatattctgtaagtgtctattaggtctattgggtctatagcacagattaagacaagtgtttctttgttggtttgctgtcaagtttatctctccaatgatgaaagctgggtatttaagtcccaagctattactgtattgagatctgtctctttctttacctctaattgtatttgctttatatatctcggtgctccatttttgagtgcatatttacaattgttttatctttgatgtagtttatatatttgtccctgccaaaatctcatgttgaattataatccccaacgttgaaagtggggtcggttgagaggtgattgaatcatgggggcagatttctcacgagtggtttagcatccccttggtgctgttctcatgacagtaagttcccatgagatatggtattttaaaagcatgtggaacctctccccatgttctctctttcttgctcctgcttttgccaagtgaggtgcctgcttcccctttgccttccaccatgattggaagcttcctgaggcctccccagagcaaatcttctgtgcttactgtatagaatgcagaaatgtgagccaattaaacttcttttctaataaattacccactctcaggtattttttatagcagtgcaaaaattgcctaatgatatcttcttgttgagttgaccactttatcactatatggtaaccttcttcgtctctttttatagtttttgccttgacatttattttgtctaagtatggctattcctgctccttatcggtttctattggcaaggaataactttttccattcctttatttttagttgtgtgtgtctttataggtgatatatgtttcttataggcaactgatcatggagtcttttttttatccattgagccatcctgtgtttgcgttggagagtttagttcactttcattcaatgttattattaataagtaaggacttaaccagtctttttgttgttttctggttattttgtggtcttctcttccatttttccttccttcctgtcttccttttagtgaatttgattttctctggtggtatgatttagttccttgctttttattttttgtgcgtctgttgtatttttttttttaatttgaggatactatgaagcttgcaaatgctgtcttttaaaccattattttaagctgataacaacttaacactctttgtacaaacaaacaaggaaaaagaaaagtaataaaaactctacaccataacttcatcactctaccttttaacttttgttgtttctaattatatattattatactgtatatgtcttgaaaagttgttgtagttattatttttattggttcatcatttatttgaacttaagagaagtttacacaccaccattacagtgttctagtattctgtgtttgtctgtgtatttaatattaccagtcagtcttttaccttctgatgatttctcattgctcattaacatccttttctttctgattgaagtactccctgtagcatttctggtgttgatgaaatccctcaggtttgtttgtctggaaaatactttatttctccttcatgtttgaagaatatttttgctagatatactattctagggtaaaacatttttccttcaacactttaaatatgacatgctgctctcttggggcctgtaaggtttacactaaaaagtctcctgccagacatattggagttcccttttgtgcaatttgtttcttttctcaactgcttttaggatcctttctgtatcatagacctttgggagtttgattattaaatgccttgaaatagcctttgtggggagttaaatctgcttggtgttctataaccttcttgcatgtgaatactgacatctttctctaggtttgggaaattctctgttattatccctttgaataaactttctgctcctatctctttgtctgcttcctctctaacgtcaataactcttaaattttccatttagaagttattttgtaaatatattaggtatgcttcattgttttttattcttctttattttgtgtcctgtgactgtattttcaaataacctgtcctcaatctcactaattctttcttttttgtatgtgtaattgtgggtttttatttcacttgggtaaataactaggagtgggattactggatcttatggaaagcatacatttaacttcataagaaatggccaaactattttccagaatagccacaccattttacatttccaccagcaataaatgagactctgttactcctcattctcatcaacacttcctattgtcactattttttaaattttagctattcaaatggtatgtggtggtatctcattgtgtttttttaataccacattttaaaatttaaaactttattattttaattttatattttctaattgacaaataactgtacattttcataaggtgcacagtgatgttttgatatatataatgtgtagtagtcatatcaaggtgaagagcatattatcatctcaaacatttatcgtttctttatgttgccaaaattaaatatagtcattctagctacttgaaatgatgtattattgttaactattgtcataatagagtggtatagaacactagaagttattcctcttatctacttgtaatttagtttggatttttttgcatttttcttttttttatttaacttttattttaagttcaggggaacatatgcaggtttgttatatagataaacttttgttataggaatttgttgtacatattattttttgacacaggtattcagcctaataatatccattagttatttttcatgatcctctccttcctcttaacctccacttatatatatatatatatatatatatatatatatatatatatatatatatatgtgtgtgtgtgtgtgtgtgtgtgtgtgtgtgtgtgtgtgtaagatatatatatgtaagatatatatatacatatcttaaaatatatatagattttaaattacttttggcaaattttcttcctgcttcctcttgtaatcttgaaaaaaaacttgatagtttttttctgtttgcaactttgagtttctgtatgtatctatgtctctactaaattcttttgttaatatatatttatatatgttgatctgtatttatatatctattattattgatattttattgttatataaatcaatatatatctatacatattaatatgcatattgacttatatatatcaatgagagaattgtgtatattgactaattttaattggtgaataattattttaagcaactttgagtctgtgacagatattctgatatgatttacaaatgtgacatgtgtgtcaaaaaatatggtttttttaatcaatgattttctgttatatatgtatatttttgcatttttattatggtccaagccaggtattcaaaacccaggatatatcaaattaaaaagtaattcataaatttaaaattattattatgcaacgatttcataatttctaatgatataaaagcaccacagcttctgggacttatacaatattcacttgtttgattaagacaatatgacaaaattccataaaggagatttttaaattgattctttttctatggcaaaataatatagaattttgttaattctaattctttcaataactgtaaacttcaaggtgggagaaatagcacccccccacccctccgttatctctgcaaagtagcatattatataaacctgtaagcacctatgaaaggcaaaagaaggcttaatgacaggggattatattcttcattgtaaccattctcaatatttcttcatgagtatgtattcctcacactagtaaataagagtaatatgaaggaagacgtgtttacagttctctttcctcttgattgacaaatgtacttattattttgaacatatctcactgtgactggaatcctgtcaaaagtgaatgtgaaggcaagagagcacatataatgcacatattttataaagtgcaaataaatgagcaatggagaaaagccctcttgtaataaagatttacaggatgaacaaatgggtggttattcagaattatagttgtatatcaaactgtagccttctagggggtaatttcgataactgtgatataaatgaagatggagtgtggttgccaaatgatatggattaatgcagagaaattgccctctcaagtagctggattttatgtgtaactttcatgatattttcacaattgtccactaatttattgatgcttcatttgcatgccaaatggtggcattttggaagaagtataaaagactactgtgtttaatctaattcaacaagtatttattgcatcacttacatattcaagctattgtaaggaacacaaaagagataatgaaaatggtcccagccctcaagcaacttttaaactactgaggatgacacatgaaaccatgaaataactatttaactgctaacaactggtgcagagattgagtaccatagaacttcagactagagataaattaaaaagcacttgaatgatcaggaaatcttcatgaaagaggatgtcaattttgctgtcatggatgtaaattttaaaacaatatctaacccatgtattttatcactatgagcgtgattgtgtgctatatcgtgcagaatatatgtaaatgattaaaccatgtcctcaaatattttataattcaggaggataagagacaggttcacaaataactctcatataaggcagaatattatatagtacaaataaaaacattaaaagtataacaacgttctaagaaggtggttatgacaaataaatgagaagttgtggaaaacgacatggtatttaaacatggcattttggatggtgttcaaaagaaaggttaggaaacagagaaaagtagctagtccagcatgaagcaatagaaataaaagctccggagacgggaacagcacaggccttattttggataaagtaaaccagtagtaaataaatgtgaaaaatgaaataaattatcacactgagcattggcctaaaattcaggttgaagcactattcttatttctctgggtatgaagagccattgaaggtttaaacagagaataacttgattaaagctgtgattcagaaagatcagtggaccaaaaaaaatttaatggtgaaatgaaaatggtgaataacagaaatagggaaataaattgctttgacctcgtgtattttgatgctgttaggtgcttacaaattaagatttgttatttcttcttcatcttgaaacctttatcattacatagtgttgtaaccgagcgagttatagagaaatgccacactctgagactaattcaggagtcctttattgccggcgaccgaaagacggctagtactcaaaattctcttggccacaaagaaggggctagatttcttttttgtaccttggtctaaaagggaagggggagcctagctgaagcaatttttacagtagcagaacaggcaaaaagttaaaggaattaatggttacagagatagttaacagaaaaataaacagttccaggtgcagggggtgaaactatcacaaagagataatgcatgggctttgggtaccatccaccgagcacgtccctaggagctgctggtgcagcttgtctcaatatcttattagtaagtgcattcctggatgtgcttggagtcagcttgcactagttaagaccttgaggaagtggggtgggtaaggggctgcaagtgaaggagccaaaatggagtctgtctggctctctcagctaagggagagtcaatcaggttaaaacaaggtagggcatcacattagtacctgtctatattcttgatacttgttcttgctctgaagtcttctctgctgaaattaatatagctacttgactttccttctgatagatgttagcatgatacatcttgttgcatcactttacttctatcttatatatctacatttatatttaaagtgagtttcttgtaaaaaacaatctttgtcttttcattggtgtaaacaattgacaattaacgtgattattgatatagttaaattaatatgtacatattttttctgttctttatccttattttttcttctactcttttttctgccttttgtcgtcttaattcggctttttttgagattccattttatctacttttttttagcatatcagtgatacttattttacaactttttaaaatgggttgccctacggtttgcaatatacatttgcacttgttccaggtccaccttaaaataacttgatagtgcttcctaggtaatgcaagcaccttataataacacatattcccaatttttctctcatcccttacatcattgctgtcattcattcacttatatataaagcataatcatatatttttgttatggtcattttgaaagaaaactatctgtcatgtcactaaaaaaataaaattaaacatttcaattttatcatcacttattccttctctaaagatctttttttatggagatatgatcatctgacttgtataattttctttctctttgaatatattcctctaacatttgttgcaaggaggatctactggcagcaaattccctcaacttatctcatctgcaaaagtctttatttctctctcatttttgaaggatggtttttcaggatgcagaattctaggctggtaggggtattttttttcttctcaacaatttaaattttcactctcttcttgcatgctttctgaggagaaataagatataattcttttctttgttattttataggtaaggtgttcttttacttcttctggcatattttttcaaagagattattttttacctccccctaccaaggtgcacacagtaattttttccgatcttcactgtgaaaatatagttgggctcctggaggtaaagctcacaaaagagtgaacatgcgtcctaaaactgagtccccctggagtttgtatgtctacagctgtcatatttaaagttgagaaaccaagatcatgctaagatgaggaacaaagtaagaaagtccactcttaatgctcctatcaacatcatactggaagtcctagttaatgcaataaaattagaaatggaagtaaaggtatacagattgaaaaggaaaaaataaaattctttttttttttagttgggatgattgcttatgtagaaaatttcaaagaatcaacaaaatcttctggatcaaatatgtgattacagaaagtttgcagtttacaaagttagtatacaaaagcaattttctttttctttctctttttttctttttttttttcttattttattttattttgtcaccaggctggagtgcggtggcactatcttggcacactgcaacctccgcctcccgggttcaagtgattctcctgcctcggcctcccgagtagctgggactactacaggcacatgccaccacacccagctaatttttgtatttttagtagagacagggtttccccatgttggccaggatggtcttgatcttctgacctcatgatctgcctgcctcagcctcccaaagtgctgggattacaggcatgagccaccgtgcttggcccattttcttttttatatactagaagtgaacagttggaatttgaaattagaaacacaatgccatttatattgacaacaaaaacatgaaatacttaggtacaatctaacaaaatatgtataagatgtacataaagggaaactaaaacattgatgaataattaaagatgtcaactttttcaaaattgtccatagattcaatgcatttccaatcaaaattcaaaattgttttgtggattacagcaaactgattctaaagtttatgtggaaaggcaaaagaccccaaatagccaacacaacattgaaggagagcaaaatgagaggattaatactacccgacttcaagactatattgttacaataatcaacatattgtggtattggtaaagaaacagaaaaatagatcaatggaacagaatagaaagtccaaaaatagacctacattaatataaccaatttatatttgacaaatgagcaagaaagttcagtggagaaagaatgctcttttcaacaaaatgtgctagaataattggacattcatatgcaaaaaaatgaatgtagacacagaccttgcacattttacaagcaatagcatcaaatgcattgtagacctaaatgtaaatgctaaactataaaactcccagatgataacataagagaaaatataggtggccttcggtttggccaagactatttagatacagcaccattagcataatctatggaaaaaaggagatacattggaattctttaaaattataatgtttttctgtgaaacatcctgttacagagaatgaaaatcgagtcatacagtgagacaaaatattttcaaaacatacacagaatgaagaatttgtattcacaatacataaagaattctagaaactcaactgtaagagaagaaacatctcaatattaaaaacagataaaatatctaaacagacacctcatgaaagaagatctgcaaatggaaaataagcaaatgaaaacatgctcaacagcatatgtaattagggaattgtaaattaaaacaacattatgatggttaatattatgtgtcaacttcattggattgaaggatgcctagatggctgctgaagcattgtttctgggtttgtgcaaaggggtgttttcagagattgacatgtgagtcagagtactgggaaaggaagacccagcctcagtgtggataagcactatccaattggctgccaacagagatagaacaaagggagcagaagaagggaggtattcagcttgctgaggtctcttgctctgaccgtccctccccttgccagaagttagctttctctcttcatgcccttggtaatcggactccaggttctttggcctctgaactctgggacttgcaccaacaggctcctgggttctcttgggcctttggcctcagactgagggcagcactgtcagcttcactggttttgaggctttcacacttggactgagccacactatcagcttttctcagtccccagctggcagaagtcctatcatgggaattcacctttgtaatcatgtgagccaattctccctaataaatcccttttatgtatacatatatcctattggctctgtcactctcaagaaccttgattgatacaataagaaacaactatataacaattaaaatggaaaattccaaaacactgatagcacctaatgctggcaaggaagttgagtaacaagaactctcattctttgctggtgaaaatgcaaaatggtacaccactttggaaaacagcttgaaactttcttacaaaactcatgtttatagcagccatactcataatttccacaacttggaagtgaccatgacatccttgaataggtgaatggatgaactatgtatggcacatccattcagtgggatattattcagtgataaaaacagaaagacatagatgaactaatttcactaggtggaaaaagccaatctgaaaaggctgtatgctgtgtgattccaactatttgacattctgtaaaagggtgaactatggagacagtaaaaaggtcagtaactttcagagatttaagggttctaagggagggaggagtagatggagcacaaggaattattagggcagtgaaattatttctctgttgatattaaagtatcaatattaaaatatatacacgtactatgtacccacaaaaattaggaataaaaaatttaaaacaaaccaaagtatatatttattttcatgtttggttttcacaaattttaatatgatgtgtttaggtgtggttttccttatatttatcattcttgtggtttgtagcatttcctaaatctgtcactggtattttccagcttcaagagtttcttagtcattagtttttcaaatattgttgttgtgccatctttctcttctattcttctgtaactcgaattatacatttttatacttttcaccatgtcccaaatgtctcctacacttacttctctgttatctgttctatttttctcccaatagctggatgtggatattttcttctggtttatcttctaggccattaattttctctttagctgtctaacgtactatgaaatctatttactgagttcctaaaattgcttattgtatacttagtcctaaagtgtccatttttaatttcttcagttctctgctaaaattgtctaacttgccattcagttttttgaaatatcactccagataattttagtttttgcctgatatctcaaatacctgactatattgtgggtcaattgcaatggtcatgcttacaattaatgtttgcttaagttgtgtcttttcctatgtctggttattttttattcaggatagtatgtgcggaaaatgtacagatactttaaaactccatctgatgttaacttcttcctaagaggtttcattttgtttccctcaaccagatgtgctaatagaagatcaccttaatcatgtggtaatgagtttattattagaaactgggtttcagtccttgttgagattgagctatttctagttctctcttactcttagagaatagcccttagagataccaacagtttaggttgttagctaggtccctctaatttgaagtctcagaactgccattttctcccttaactctgcaaaacttatgaaagctatatcctcaattaagaaactgtcacattcccttcactgctaagcctattgcccgctaattttgaattggaaaattccccaaggacaaagcaacatcaacatcaagtttcatattctaataaagatattggaacttcaaagctgaaaccttttagagaggggtgaaggaatgcttcagaagtcataaagaaaagcaaagaagacatttacccttcttctagttatacttctaggaagatactggagaaatagtcatcacgtttaagagctgaaatggaagaacagaattagtgccgaaacagaaaagccaaatttcagtaaaaaaaaaaaaaaaaaagataaagagacctacatgaaaaatatgactataaaagtttttaaattcgttgtcaatgtatgcaattcataattatgaccagaattttagagatgacacagttgcaggtagtaaacaaaaattaaaggtgttagagttattttatgtgtgtcttgattaattagaagattcatatttcattctttgcttactttgtgatttctttccactttcctatggactaaatgggtattgttttgacaacattttgagtaactatgtttcaagattgtttgtaaaatatctgttatcaaatattggtaaattttgagatgcttatattaaaatatcggagtgagattatatttaagaaataacagtatactagtcaaaaaactaaaatatagtacattttaaaatttagttttttaatacataccaaataaagtcatcaactaaaatgagggtggatttatcaaacactatcttccactttcaggattgaaataattctaacagatgttacagaacactattttatgaaagtattgtctttggtatgcaatttagtggaaatagcttatgttgatatttgccttaatttaatatttatttttactcacccagggcagtagagcttaactgcaagcctgttatttaagagaaaatggcctctgtttctaacattgtcagttcaaaatataaacagcattgaatgtgtcaaacccatatgtaggtggagaatctacatcattatcattttattcagatttcttagaatctataagatattgataagaaataggagcttccaggatccgtggagttgaaggggcgtgaaaaaaagggttagaggtcattaaagtaagaactactagtaattttcaccttataagaaacaatggcagaaattcaggtttctatggcataaatcaaatgatatttgaaaagcaaacatttgaaaaaaatcacttaatctctctaagttacaactcctcatctctaaaatgaaaatggtaataaaaagctgtatttatttttataagtatttgctgagccactgatgggaaaatattttgtgatataagcaatgaaatattttaaaattcactttgggaggccgaggcaggcagatcatgagatcaggagattgagaccatcctggctaacatggtgaaaccccgtctctactaaaaatacaaaaaattagccaggcgtggtggcaggtagctgtagtccccagctactctggaggctgaggcaggagaatggcgtgaacctgggaggcaaaacttgcagtgagccgagatcgtgccaatgcactccagcctgggtgacagagcaagactccatcccaaaaataaataaataaataaataataaatattgtggaaaaataaaattttaggaatgcttatctcaatgtcttacttcatttgggctgctataacaagcataccatagactgggtggcttataaacaacagatttatttttcacagttctgcagactcttaagtctaagatcaaggcactggtagattcagtgtctggtgaggacctgcttcctaacatgtcttttataagggcactaatcccattcgtgagaactctgtcctcattagctaatcacctctcaaaggccctacctcttctactgtcacattggcagttaggatttgtttttttttttttaacttttattataggttcaggggtacatttgcaggtttgttatatagggaaattcatgtcactgggatttgatgtatagattatttcgtcacccagatactaagcctggtacccaatgtttttttttctgctactctccctacttttaaccgccaccctctcgtaggcccctgtgtctatagttcccgtctttgtgtccatgtgttctcttcatttagctcccactgataagtaagaacatgtggtgttcagttttctgttcctttgttagcttgctaaaaatgatggcctccagctctatccatgtccctgcaaaggatgtgatcttgttcctttttatggctgcatattattctgtgttgcatatgtaccacattttctttatccagtctattattgatgggcatttaggttgattccatgtctttgctattatgaatagtgctgcaatgaacaaacatgtgcaagtgactttataatagaaagctttatattcctttgggtatagaacctgtaataggattgttgggttgaatagtatttctctctctgggtttttgagaaaccgccacactgtcttccacaatgttttaactaatttacactcctaccaacagcatgaaactgttcctttttctccacaatcttgccagcatctattatgtttttactttttaataatagacattctgtgttggcaacaggctgccaaatctggccgtaaacaggcccccaaactggccataaacaaaatctctgcaacactgttacatgctcctgatggccatgacgcccacgctgaaagtcgttggtttaccagaatgagggcaaggaacacctggcccacccagggcggaaaactgcttaaaggcattcctaaaccacaaacaataacatgagcgatctgtgccttaaggacttgttcctgctgcagataactagccagagcccatccctttgtttcagcccatccctttgtttcccataaggaatacttgtagttaatctataatctatagaaacaatgcttatcactggcttgctgtcaataaatatgtgggtaaatctctgtttgaggctctcagctctgaagtctgtgaatcccctgatttcccactccacactcaatatttctgtatgtgtgtctttaattcctctagcaccgctgggttaggatctccatgactgggctggtctcggcaattctgactggtgtgagatggtgtctcattgcagttttgatttgcatttctctaatgatcagtgatgcagagcttttttcatatgcttgtttcatcatgtatgttttcttttgagaagtgtctgttcatgtcctttgcccactttttaatggggttgtttgttttttccttgtgaatttgttagttctttatagatgctggatattagacctttatcagatgcattgattgaaaaattttatcaaattctgtaggttttctgtttattctgttgatagtttcttttgctgtgcagaagctttgtagtttaattagatcccatttgtcaatttttgctttcattgcgattgcttttggcatctttgtcatgaaatctttgcctgtgcctatgtcctgatggtattgcctaggttttcttctagggtttttatagttttacattacatttaagtctttaatccatcttcatttttgtatatggcttaaggagagggtccagtttcaatattctgcatatggctagccaattctcccagcaccatatattaaaaaggaaatcctttccccatcgcttgtttttgtcaggtttgttgaagatcagatgctggtaggtgtgtgttcttatttctgggttctctattctgttccattgatctatatgtctgcccttgtaccagtaccacactgttttggttactgtagccttgtagtatagtttgaagtcaggtagcatgatatctccagattatttatttatttatttatttatttatttatttattgtgacagagtttcactcgtgtcacccaggctggagtgcaatggctcaatctcagctcactgcaacctccacctccttggttcaagcaattctcctgactcaaactcccgagtagctgggattacagctgcccaccaccatgcccagctaatttttgtatttttagtaaagtttgggattcaccatgttggccaggctggtctcgaactcctgatctcaggtgatctgcctgccttggcctcccaaattgctgggattacaggtatgagtcactgcgcctggcccagatttattctttttgcttagcagtgctttggttatttgggctcttctgtggttacatatgaattttaaaatagtatttttttctagttctttgaagaatgtcagtggtggcttaatggaagtagcattgaatctataaattgctttgggctgaatgaccattttaataatatttattcttcctctccatgagtatggaatgtttttccatttgtctgtgtcatctcttatttctttgaggattggtttgtagaccgccttgtagagatcctttagctcccttttcagctatattcctaggtagtttattcattttgtggtaattgtgaatggtaattcattcatgatttagttctcagcttgcctgttgttggtttataggaaggctaacgatttttgctcattgattttgtatcttgagactgtggggttttctagatatagggtcatgtcatctgcaaacaaagatagtttgactttctctcttcctgtttgaataccctttatttctttctcttgcctgacattcctggccagaacttccaatactatgttgaataggagtggtgagagagggcgtctttgtcttgtgcctgttttcaaggggaatactctcagcttttgcctgttcagtatgatattggctgtgggtttgacatatatggatcatgttattttgagatatgttccttcaatacctagtttattgacagtttttaatatgaagggatgttgaattttatcaaaagccttttctgcattcattgagataatcatgtggtttttgtccttagttctgtttacgtgatgaatcacatttattgatttgcatatgtcaaaccagtcttgcatcccagggattaagctgacttgaacatggtggataagcttcttgatgtgctgctggattcggtttgccagtatgttgttggggatttttacatcaatgttcatcaagaatatttgtctgaaatttgttgttgttgttgttgttgtatctctgcaaggttttggtatcaggatgatgctggcctcatacaatgagttagggaggagtccctccttttcaattttttggaatagcttcagtaggaatggtaccagctcttctttgttaatctggtagaattcagctgtgaatctgtgttgtcctgaaatttttctggttggtacactatttattactccctcaattacagaactcattattggttttttcgggtattcaatttcttcctggttcagtcttgggagagtatatgtgtccaggaatttatccatttcttttacattttctagtttgtttgcatagaggtgttcataattgtctctgatggttatttgtatttctgtgaggtctgtggtaacagcccttttgtcatttttgacaaaacacacacactctggctttttgagatgtcagacttcttgcgctggttctttctcatctttgtgggctgatgtttttcaaatctttgaagtttctgtactgtggatgggctattttttttttttttttttactttcatcctatttgatgaccttgggggattgattgtgatataaagtggatttggtcaactggcttcatgactggaagatttccgggggccaaggctcagctcagaactcctgcctggattgtatgctgtaactcaggtagactggtatcaggccccagctttgatctctggctcctcgaggttaggaacctgttgtactggaggggctgaggtgctaccagaccactggtcacaacattccagtgagtagtgccagccaaagcactttacagggctttgacagtgggacctgtccttgttcccatgtatcagcagcagctgcagcagcagcattggagggtgcacacttatccatttgctgcagcagggttctcatgggtgctggggtgctagcctcgatatggatatttgcggcagcagtggtggcagtatggcttggtggggtgaggagcccccactgggactgtgtgcatgtccctgcaggtggaggttttagtgtggaggtggggcatcagtgggtgcaggactgtgtgcaccctctgtgcatgttcatgctggcagcagtctgctcaaggctggggctagtctactgttttccatgcctaattttgctctggtggcccaggctcaggggcagggtgctggcaggggtagggctggggtgctctgagcccgccaatgttctgaagacaatggcggtgtgggaggtgggaggaagggtgagggggcacactcacgctagcagcagtgtcaaggcagggtgcaggagttccagtaccagtgtgctggcagggaagggaaggctaggtctgcctgggcatacatgcacaggcatagcaatttggatggcgaccatgggtgcaaatgagctgttgtgtgtctgcagagatcactgtgctgaagcactctgccagtccggtgtggtccaccagctgtgatgtgagccccaggaggcacctggcaactgtgctgcaaacagccgtggccaggctggggacctgcaggagtccaacagaatgagaggtgctctggttgtactggtcctgcttcatggataagattgtcctatagagttcaggtccaaaagttcccttagggctaaattctcctgtggcagcgattctagcctagggggatgcacgtctctgagagtgctccactacagttgctcccacaggacaccctctgtgctctgcccccggctggagttctgcccccaccacttctctaagtagctttccctgacaatgcaagtgtccatggtagttgaggggtctcctcctgctgagattccaaaggcccacagtgaatttgggttgctccttgccttgggttgcctgttaaacgcatcctctttgtcggagtcattgggggccaggaacacgttccagtgtgcagtagccctcggaagtgttcctagcttcgtccaccttcagcccagcctctgtgttttccccctgtctgttctgcctctgactaaagctacaggataaaaacatgacagcactgggatatgaactcatttttgcctagctccaaaggccttgctcattcatgcagactctcagaaatgaaaaatgattcccttcatcttcgttaaatcacatgttcctacagacaaattctccaaagcttttatgaaacctatgtgatgctgcaatacaatcgattactacagtatttatggaatataccattcatagctttaggctacacagggacaattatataccaagctctcttgaattccatctctttctaaaacctatggatttgaagtcaggatgatttcagaagtccaactggtgttaaaaatccaaatagatcaaacattgtttctttttatatctgtgtgacaagtaataccaatgtgtgtaattacagtgtggagaaacccacgtaatttctctgaggaaagtttatttcactggaagaagtcattgccaataagcaatagaagccctaaccagtggctcttattttgcaattagactttttcatcttgatgttagtatatgtgccgccaaagcaagcaccactttttcatcttaagcaaagcctaagtttgtgtgtaatatagatgaaggctattaccagacaaacaccatcaaaaagtcattttattggtgtctttctgttgtgatttttttagtacctttctttctttcctactccctccttttccacaaatatatgttgagtatcaattctgtgatgcttgaggcattagacactttaataataatcctttaagtcttgcccgaattttagtttgatgatatggtgtccattgtgtagatgaggatacatcctccgtgaagtgcaaggtcatacaaccaaatgtggaaaagtaggtgggtctcttgctgaaaggaccttaacattgaatgctgctgcatgaagcccaaggcttcagtggagaacctcagaaaccagataactcggctggccggttgcggtggctcacgcctataatcccagtactttgggaggctgaggcagttggatcacgaggtcaggagttcaagaccagcctggacaatatggtgaaatcccatcgctaataaaaatacaaaaattatccaggagtggtggcacgtgcctgtagtcccagctgctcgggaggctgaggaagaagaatcacttgaacctgggaggcggaggtcacagtgagctgagatcgtgccactgcactccagcctgggcaaaagagcacgactccatctcaaaaaaaaaaaaaaaaaaaaagaaagaaaccagataactctgagccatgaggcatgacattggcctctcagaagtctgaataaataagtatggagatttcccttattttgaaggcattaatgactcatttctctagggtattgaagtgagttctccagtggaagacaactggaaaatgagtgtccttgtctacagacttaagatcttaataaaagtaatcataaaattgaccttggtggggagacactgaaacaggattacatggcctgagtcaagtccttacaaacaagaaagacacagaggtaagaaaaggaatattgactggagtcgggaatgcaggagcatgtgtgtgtgtgcatgtgtttgtgtttatgtaactagataagtttagatgagcctggagaattaacaagtcatgcttgtatttcacaaaaatgcactgaagaagagacatgggttggaaattgttgcagatacaataagacatagtggtgacatgaaccatgaacctaagtttatgatgatgaatttgaagagaaattctaggccttgccttagaaaacaacataaaaaacctcgttcttcaggaacacaacgcccacagacaaacttcactagaaacagaatttgtacatagacagatgtatatatcactccttacttagatgaaatatatgcatatgtgcttccatttacagatggactctttcatcactgaaagaaaaagtgcacttcagatctacactacaaatatatttagatacaaatttacctccaccagtgttacatgttatttttgtaaggtaaataagttacttgatttattattttaaacttatgagtgcattttaaattgctatgaatgaaatgaaaattatttgaactttatcagatatgtaaggatatttgatgttgcttggtagcttttctcatacagatcctattttacacatgagatttgccagggaattgaagctacctcctattctgcacctgtttatatgatttggtaatagtcttttgtagtgaaggcttatgaacatggtgaaatacatatattctattgagagatatgataaaatggcataactcaagtttcacctatgattttgataagtagttttcaaacttgttttgggggtttgatggaatcccaaatgggaagataacaattttactattaacaagtgttaacattattttggctatggactccaattttggttaaaaaaataattgtcataattatttcattacaattttaatataagaaggatataattctccttttactcagcacatttttttttttttttttgagacagggtcttgctctgtcacccagactggagtgcagtggcaggatcacggctcattgcagtctccacctcctgggctgaagctatcctcccacctcagcccccaggtagctgggactacaaggtacatgccaccacacctggctaatttttggatttttttatagagaccaggtttcactatgtttcccaggctggtcttgaactcctgggctcaagcaatccacccacctgggcctcccaaagcggggaggattacaggcatgagcaaatgtgcccgaccctatttctcttttaaagaataattctaataataataatttctggttttatgtatttttacaaataattgacatgatgatgtaatattcacaatgcttcaacaatgtgaaaaagtatatgtgaatattaatcacataattgataaaatatatgaaataatgaagccaaagcagttcattaagaaatattgataaacattaggtattgaatttacagatgttgccaaagttgtgcatccacggggccagtcatcataaattatgattgatgattaaaatgagagcaagaaatacccaattgagtagtaaattgaaaactgcctaatcttcttccgatgcctctacgatttctttgtacttgtaaaatatcattgcacgttgaataggagtcttaacagagtcataagtccatcccctcctggcaaacagcctttgaatgatgccaggcatttcatagcccttgcttagaatgaaatccttaaaggcaattggtccataaagatcgtcaagaacgtcaggttcatcaggctttttaagtaagagcttggggtcaatcaaaggttcatcacttcttagctttttccacaacttaggcttgaggtaccatgctccatacttcatcttcacacgctgtgcggtataagaattcgatggcgtgtggaatttcctgccccagtatttttcctgtgagaagaatttgtcctcatccttttcatctagctccatgctgtacttcagctctgaggaacactcctttactttcttaaacttttggtcctcatgggttgctctgtacttgggggtaaagtcaaacagattcctgatggattcttcatcagctcccaggtctccagcccacttgaagaattcacggagtttttccgatgtgtatctatattgaagagagtcagaaacgcactcttttgtgcttggtgtatcttcctgaagcagttcttttatgtaggatgctcgaatcttgggaggctccgagaattgatgggactctggagctttgggaggctccgggtggagactggacacccgacgactcttgggaagctccgggcggagactggacactcgacgagtcttgggaggctccggaccgagactggacgtccgacgagtcttgggaggctccgagcggagactggacgtccgacgagtcttgggaggctccgagcggagactggacgtccgacgagtcttgggaggctgcgagtggagactggacctccgacgtgtcttgggatgttccgggtggggatgggacacctgagtctcgggaggctgcaggcagggttccccacaaggggatttatgaggctcggtgggttccttagttttcttcacccgggcctcacaacgatcccatacgtccttcagcgtcctcccagaatccagcactttcagtatgtatagtaggagattggacacctgactagtgtcgggaggttccaggcggagatggcacactccagtcttgggaggcactgggtggagatgagacacttcagtcttgggaggctccgggctgagatgggacactccagtcttggaaggctccgcgtggagactggacccccgacgagtcttgggaggcgctaggcggagacgggacactccagtctcggaaggctccgagcggagactggacccccgacgagtcttggaatgctctaggcggagatgggactctccagtctccggaggctccgggcggagactggacaccggagtcttgggaggctcctggcggagatgggacagtggagtctcgaaaggccgaggacagaatttcccacaagggtatttaccaggctctgtgggttcgtcagttgtcttctcccggccctcacaaggagcccgtgcgtcttccagcttcctctcagaatccagtttcagcagctgtcgtaggagactggatctccgacgagtgatgggaggccccgggcggatatgggacactccagtctctggaggctccgggcggagatgggacactccagtctcaggaggctccgggcggagactggacaccggagtcttgggaggctccgggcttagatgggacactccagtctcgggaggctctgggaggagatgggacaccggagtctcgggaggcttcaggcagaattccccacagggatgtttaccaggctcagtgggtacctctgttgtcttctcctgggtctcacaacaagcccaagcgtcctccagctccctctcaggatccaggtgtttcagcacctgtagtaggagatctggaggcatatcttctcccagattggggtacatggccaagggatgcttggccattagctgggcttccacttgctctacgaacgccttccgtgctagctgggctggagagagcttggaaaatagggccgctttcttgagcagctttttctgcccgcttttggggtcagcttggggacctctgagagatattttggggagtaaaaactcgtcacggcgacaaacgagagtatcttcgggagacggacagccgtagcggaagtcgtccatgccctccttcacaaatacccagttctgggtgtccatgggtgggaacctcaggcgcctgtgcttgcacttcgcgaagcacttggaaggccgtttgttacagtaccagggcttggagtccatgcccggggacctcagccagtcctgcagcctctggtcccccatggtggccctcgctgtggtgccacgtctccagcttctgaggtcccagatccctgccgctctagtcgctaggagaccgccagccacgcgcagcccaggttccttcctggaggcggagcagcgctgacgccacctgcgcagcccagattctaacaggtgtgtagtggaatctcattccgggtttcatttgcgtttcctaatgactactgatattgaacatctctatatttgcttatttgccatccttatctctccttggttgaagtttctgtggattttttccccatttttaaattgtgtttctggatatcatatttagttttgagaatacttgctgtgttctagatgtaaataggttatcggatatatgatttgcaaatttttcacttcatccttggcttttccctttcattgtcttaacagtgtcaaagagaagtttttttaatttgatgaagtccaatttatcagtttgttcttttatggattgtgcttcttttgatgtatctatgaaaacttggcctatccaaaggtcaaggttttaatttttgtaaacagcacaagatatagatcaaagtttttatttaaaaatgtacctattgcttacatatatctgataattttagaactatttttgtaaagactaaatttttctccgctgaattacatttggaaattggtagaatatcagttgtgtatgttttttgaaggtcaatttctggacactcttttctcttccattgatttttctctcacacaaatttcccattctgttggttactttagctttataataaatctagaaattaggctgtattagtcctttaacaatgttcttttacaaagttagtttttcctaggtcctttgaatttctatagaaattttaaagtcagtttgtcaacgtcaaaaaaaaaaaaaagtcctgttgggaatttgattaggattttgttgaatctatagatcaatttgaggataattggcatgttaacaataggaaatctgaccactgagaaatgtacagctttctatttgtttacgtgatttttcattttctcaggaatattgtgtgttttttagtgtatgtgcctttcacatctttttctctccagatttttcctaaatattgtttttcatactattatatgtagtatttttagttgcaatttccaattttttgttgttagcatatataaatattgatgtttgtatatccattggtatcatacaaccttggaaaattcactcattatgttcagaagcatttttgtatatttcattgaattttctatatatatgatagtgtcatctgtgaataaagacagtttcccttcttcctttccaatctgaatatcgttatacctccaccagtccagttgcaacccttcattttcctttaaataatatcagttaaatttttatctctcttatagtgcttaaaacaacgctatgaaaagcatttttataaaaaattttaattatagacaaattcagcctgcattattccttaagcataccattttctcatcacataataattttttctgtacattcttactcatttttaaaagaaggtttcttacttcccttgttaggtgcagctgaacaatgttttctaccattacaagcaggtataccctagttcctccttgtaaatgaggtacgatcaatgcctctcttggttttggctcctcctctgtaaaatagacacaatatatattcctcttaggtttctcattaaatcaaagaactagattatgtgtaaatcaaaataatctatataacatgactttgtatagtgtctggaacagaataagcatcctctaaaatcttgttaatttatatggtattactacagtttgaaaataaaaatattctacatttgatgtctatataaaggaaaagcaacatcgtacatttacatatcacaaatattttcatttattgattataagaatctatgttaaagtctcaaggtatttagtagatttcataatgtgatgttggtaagaccaaatttgatatggatttatttttaactttctttttttttttccttttttatttttattatactttaagttctagggtacatgtgcacaacgtgcaggtttcttacatatgtatacatgtgccatgttgctgtgctgcacccattaactcgtcatttacattaggtatatctcctaatgctatccctcccccatccccccactccatgacaggccaccgtgtgtgatgtttcccttcctgtgtccaagtgtttgcattgttcagttcccatctatgagtgagaacatgcggtgtttggttttttgtccttgtgatagtttgctgagaatgatggtttccagcttcatccatgtccctacaaaggacattaactcatcctttgttatgactgcatagtattctatggtgtatatgtgccacattttcttaatccagtctatctttgatggacatttgggttggttccaagtctttggtattgtgaatagtgccgcaatgaacatacgtgtgcatgtgtctttatagcagcatgatttataatcctttgggtatatacccagcaatgagatggctgggtcaaatggtatttctagttctagatccttgaggaatcaccacactgtcttccacaatggttgaactagtttacagtcccaccaacaatgtaaaagtgttcctatttctccacatcctctccagcacctgttgtttcctgacttttgaatgatcgccattctacctggtgtgagatggtatctcattgtggttttgatttgcatttctctgatggccagtgatgatgagcattttttcatgtgtcttttggctgcataaatgtcttcctttgagaagtgtctgttcctatcctttgcccactttttgatggggttgtttgtttttttcttataaatttgtttgagttctttgtagattctggatattagccctttgtcagatgagtagattgcaaacattttctcccattctgtaggttgcctgttcactctgatggtagtttcttttgctgtgcagaagctctttagtttaatagaaaaattccatggactgtatgttacattcaagagccaatgcttcaacaattctctataacaatactctaactagcaagctcatgtgagtactcacttatctaaaatgcatgagagtttgaaaaagtcttctatattccaaataatcccagaaaaaaacatgtatttaatctcctaaagttcaattgcgcctatataaaatttttcatgtgactgttcattaaaacagtttttgttccttaaagccacttcatttttttcacttttcacagtagaatattatacaagggactcacatctagaatacataaataattcttaaaacttaataagaaaacaaagaacagaaaacaaaaaatgtataatacacagtagtttaacatatagaggtatatagctaaagaaataattatagatgtgtgtacatattggttagtatacatgcttatgttttatagctctgtctctgctgagaaactagaaaaaaatgacacccaagtaacaagtacatccagtgcccaaatcttggtttctaaataccattctctaaaataacaaaagcaaaacaaaacagagatatccttggagaaatgagtaattctaggcctggggcagtgaaaacacaagattagcctggagtattatgtaatgccagaaaatatggaagttctcagaaaacaaaagaatagaagcagatcaggagccaaactgaaagggcactcaatggccaaagttaaaacaatttaggcaacaaaatgaattaaaatttaaaaattataacacaatataaaataaaatatccatgagtccatactgatataaataattgtacaaataaataaatgaggaaaaaggtacaaatatttttacaaagaatttcagaaaatgtacagggatactcctcccttcaggaggtggaagttaattgtcctccccagggtgtgagctggattctaaacagtaaaatatggaatgggaaaaaatagtgaccttttagtggagaagcctggcggttctctccttaagcaagtgatcaatgttaatatcagcagtgagaggtcgcattggtatcatgcacttctctgataggatgtgatgagaaagacacttcacttctgtagtattctcccctaaattccggaatcctagtctaatgaggagaaaacatctaacaaactcaagtccagggacattttacaaagttctcaagtactcctcaaaaccataaaggtcatgggaaacaagtaaagactgagaaccggtcatagactttagattaaagagacaggaaaactaaattcaatgtggcaggctgggttggatcctggcactgaaaaaggacatgggcgtaaaaaatctccaaatctgaattaagtctgaagtttagttaatagtaatatttcaatgttaattttttagtttaaatgcatgtacaatgtaagatattaattttaggggaagctgagtgaaatgtgcatgaaaatgctttgtacagcctttgcaaatgtttcataaatctgaaattattctaaaataaaaggtttccattttaaacaatagattgcatcatgatgaattatcaacaaatcactattaatcatacaagagagaaagctgtagcttctttaaaatgcatacttgttgtcccccccgcatatacagtaaatcatattttttttctaagtggagccagtaatctacatttcacatggtctttaaattatacacaccaatatgtaagagttacttttctaaagccctttgccttttataggtcccaaagactttcaaagagattaaaaaccacagtagtaatggtatcatccaaagtaaccaaatttggggaaaatgaaatttctgcatatactagatggagcctgagaacggaataattcccttaggtaacatgcacatacctggtgggcccacaggttaatgaagtcatgatagaagagtaaagaagatacaaagtttggtgactgacagtgaaaaaaaaaaaaaaaaactaggagtgaaagcaacttactcgtgcaaactgcccttcttgagttgaagaaaactgacatcactgtagagtgcagagaaattacaactggcctgttcagtcaagaagcaccaactgccttagtatgaagtgttactccagaaatgaatagtgtagctgacaagcaaaaccaacaccaacaagctaataaagaaatgttcaagcaagtcaaaatgctctgagtggagcagcatgtaatgaataagcaaacaagggaatgagaacaaacaatgaaaatcaatgcgatgaagtgcattggtttaatggagcctaagtattcccagttctgacatctttgtgtgcctctgactgctcttagttacctacaacctttactgcatacttaactcaggacaccattttcatgctccagcagactccagttatctgcaaccttgctgtctcttccacccacacgcggcacctgccagcctttctcagatacccaatcttgttcactctgatccaaccgtctttggaattcttttgttttcattagctcttgctaagtttgctttctgtgatggttgattttctgtgtcaacatggctaggctatggtgcccaaatatttggtcaaacagtctagatgttgctgtgaaggtattttttggatgtgatttaacattttatatagtagattttgagtaaatcagatttaccctccataggaggcgtgagcatcatccaatcagttgaaggctttcaggaaaaacacaaaattctccaaagaagatggaattctccctccagactgaaacacaggaatctgtttgagtttccagccatcggaatcaggactgcaacatcaacttttgcctgaatttctaacccacaaccagctctacagacttcggatttgccaacccccgcagtcacgtgaatgaattcctttaaatttccctctctctctctctctctctatgtatatatatatataatatataaattatatatattatatatatttatatataggataataggaaatagttgaatatatagaatatagaaataataggatatatttcctattatataatatatgtaataggatatataatatataatgcataataggatatatatattatataataggaaataataggatatatattatatattagatatttatatataatatataggatatatattatatattatatatttatatataatatataggatatatataatatatatatcctattatttctatattctatgtattcaactatttcctattatcctatatgtcaccctccgctcgctcgctctctctacatatatgtaaaataataggagatatgtataactcctattattttcttatctttctggagaaatctgatgaatacactattcattttgatcatttttctaccagtaacaatgtacttgtcttataatgagacacactgcagcaattttaccactgctacacccactgatagtttttctcagcaaggtataaaatatagttaaggcctaagaaataatagacttaaagatttccattttgttctttgaataaaaatgcatagaagaattattccataccttggctgaattatcagaatcacttgtggcacatcttaaaagtatatatgccaaggctctgccctgagcttgctgaatcaaaattcctcccattgataatgattcacagtcaagggctgaaatccctggatacatagtaatttgatcacagtatctcagacaggatatagtccagctctactgatattaataaagaacttgaggcgaaaagagaacaaatgaattacacaagttctcaaaaagtaaaaatgaacaatgtcaggctagtatttttatatttctagaagattcactctatttccttgtatagatcaattatacaaaaatatgacagtattcctgtctccttgcatgcatatgtatcacctggtccattcaattcacaaatataaatagaatgtaatatttagaaaataatcgagcagacgcagctctgttttataaggtggttcagctacaaatgaaattatctagtatataattagaggacaacaaatggctaaaatcttcgcaattttgtttatggttaaagtaataaaactttgaggacaggtaaatgttactgtgtcatatcctctgatttaatcaaaaaacactggtctcactttcctattgatggaattttggtagatgcattcaacaagctgtcataaatcttagcttatttcctagtagctagcaaaaaaaaaaaatccagaatcgcttcatatcatgggtgtgaataatgtagaataatcaataatcttggttgtccacgagtgctgtcttaatcttattctttggcttcgaatgcaacatttgcgtcttttacagaattcaaaatttacagagtattgtacacatacacacatgaccagctaaaagccatgttctcagtagtgtccactttacctggctaatgtccaacgtgtgacgagcaggcaaaaatatgcaatattagtattatttacagacagattgttacaattttaaccgcaattttgaaatacgggctgttaattctatgttaaaaccacagctcttaaaaataacatgcatatacacacatatattcataccacaattcacataaaggtccaaagtttagctagttttaacgttagtgatcaaagcctaatatgtataggcaaatgtatgtacacaatacacgtgtgaacacaccacagttttctaagatattattgaacctgtaacaaagtgttgagttgtgattttataaaaatagttctattatattattacctttgtgctcatctgacacaacagtactccttcaaagagtctgaagggtatgctacatcagccagctatgtaacagccttataatgccaagtgtcctgtacagaggtttactccaatgaactggcttaatttagaatgtaatctaaccaattatatttaatagcatggctaggaaaatcagccccatagtctaaaaaccggtgtctccgggaaaaaaggaagtggactttccttttatgttctacctcttagaaggtataggaatcacaatattctatgcaaaaccagagatattcgctacctctgatcctttcctttgctccttttacatttataacaaatgaataagctgaacgtgatttttcattttgtagctgcaatctctgtagacaaactgatcaactgaaatacttacactgatttgatcaacatatttatcaatgaataaggatttaggaagttattttcatgatttggacagttgtgcacctggattcatttagaaactattgtctttttctaaatgttagagatgtttaatgtggggaagaaaaacttaaggaaggagacccacatggaggaaattgcatttttctctatagcataattcagggatacattggattacaggccagagtgatgatttggaaggaactaaaagcactgatatttgatagagacctggtgaactaaggaagcaattctaaatagattattttggatgtgaaacagatatttccagtcatcattgcagtttttagtccttgacagtgatttaaggtctgaggaatgctaagcaatgttgcaacacctgcatgtacatatgccctgcacaatcatatgccctgctaccagtagctgctctcagcacagctttcctctttcaccccaagccaaggaatttgccatacctgcaggcagtcaaagtgaagagggttgccttttaagaattatttttcatagttcccttctcaattttcagtttcaacagcctcttcccattcaaattgtctgcgtttgcctcaccttccttctcaaaccaccagttcctttacaatgcatcttcaacttaggttatataaagaaatgctaggctttgtctttgcacacaaattcctctttgagtatacctatgctgtataaattcatattactgcttgagtatacatatgctgtataaatttgtattactgccattcgtttcaagaatcacctctttcctggcaggagaaaatcaatagataagattactaatgagactggagtcctactgcctccagcacttagcagattatgaataagcctttcctcatggattgtttgtcatgtaagaaagcataactgaatagcaccgtacacataagcaaaagtgaaatgttaataatatttctacctaaagtgtatcatattaattcatattaaaataaatgagatttacaatcatattggcaggaatctactaaaagtaatatactttctagaaatttgaaactccctaaatagatgtaactgtccttgaatattaaaagacgtactgggaaaatggcaaaagactccaagaaaccaagtcaaaatcatattgtttatttttcatgtatgaacaagaattgaagaatgaaaagctcagaaggaaggtaataaatgtaaataatacataggaaacattttacaaaacttttacttttgtaaattgtgcgtttcactgagttttaacattagttggttaaagtccttatcatatttttatgaaaggtgaagtcaacaaataaaccattgagaatgtggaagaaaagttcagaaaattaaaaactcagaggccattactcatgtcaacttataaaaataatgatcacattaaacataacttactctcttaacatactgggttaatatcgtagtagcttatggaatcatagggaaaggttttgcaaggattatgcttttctcctagcatgttaggaaaaatttacactggattttggtgaagcaaaatatgtatactttcaaccaagatattccgggtctttaggctaagtaacataattacatcaaatctatttttccataaaatttaccactatatgtaggagaagatataagaacttctgtagcaatttctgtgtttgtgacaatagaagtaaaaatagcaaagaaaatattattgaatatattttaataatttaaagtaaatatattagcacatattttatagattatcaatttattagcaactaacatatttattcatcctatatataggatcagttatatatatatatatatatatatatagagagagagagagagagagagagagagagagagagagagagagagagagacaatggacatatatattttcttttttttaaattttatttatttgctttaagttctggaatacatgtgctgaacgtgcaggtttgttacatacgtatacatgtgccacggtggtttgctgcacctatcaacccatcatctaggttttaagctatgcatgcattgggtatttgtcctaatgctctccctcacctttccccctaccctctgacaggccctgttgtgtgatgttcccctccctgtgtccatgtgttctcattgttcaactcccacttatgagtgagaacacgcagtgtttggttttctgttcctgtgttagtttgctgaggatagtggtttccatcttcatccatacccctgcaaaggacatgaattcattcttttttatggctgcatagcgttccatgatgtatatgtgccacattttctttatccagtctatcattgatgggtatttgggttggttccaagtatttgctatcataactagtgctgcaataaacatacatgtgcatgtgtctttatagtagaattatttacattcctttgggtatgtacccagtaatgggattgctgtgtcaaatggtatttctggttctagatccttgaggaatcaccacactgtcttccacaatgtttgaactagtttacactcccaccagcagtgtaaaagcattcttatttctccacatcctcgccatcatctgttgtttccagactttttaatgatcgccattctaactggcgtgagatggtatctcattgtggttttgatttgcatttctctaatgaccagtgataatgagcttgttttcatgtttggtggccgcataaatgtcttcttttgagaagtgtctgttcatatccttcgcccacttttcgatggggttgtttttatcttgtaaatttgtttaagttccttataaattctggatattagccctttgtcagatggattgattgcaaaaatgttctcccattctgtaggttgcctgttcactctggtgataatttcttttgctgtgcagaagctctctagttatttagatcccatttgtcaattttgggttttgtagcaattgcttttggtgttttagtcatgaagtctttgcccatgcctatgtcctgaatggtattgcctagcttttattctagggtttttatggttttagattttatgtttaagtctttaatccatcttgagttgatttttgtgtaaagtgtaaggaaggggtccagtttctgttttttgcgtatgggtagccaggtttcccagcaccatttattaaatagggaatcctttccctattgcttttgtcagatgtgtatatatatatatatatatatatatatatatatatatatatatatatctgtcatatatatatatctgtcatatatatatctgacatatatatctgtcatatatatatctgtcatatatatgtcatatatatatctgtcatatatatatatctgtcatatatatatatctgtcatatatatatctgtcatacataaatatatatatctgtcatatatatatatatatatatatatatatatatatattctattggcaaagaaaatgaaccaaaacaggctcctgggcccatgagattaaagccaatgtctgttgcaatcatttggcatttagcacaaagactaagatacattaagtcctcaaaaaataattattgaataccagatgtgttcatgccattaaaattcagtatgctatatctgtatttgataatcccatagatcttttcttgtgttacatctaaatgaaaaattactctaagcattttcaggattatctcgatctctttacagttcaatacagccacaaaaattcagtgttcttatttggatgtgtgttttcaatcctgctaagtgagattgctgccagatggcatttcttagtgtaaaaatgaagttgtctcatgttcacccatatggtcatgttggcttattttaccagctgcaaagtgatgattaggaaaggaataatatattaacagaaggaaactgcagcaccttcagttattgaagttctcgagactctttattgtaatttatgaaagaaatcaaacttcatcagaataaagtatcactttacgtttcacaacttcataaaaaagaacttgactggacaatatttaaaggatggcttacatttcctgaaagaaaaattacattatgaatcattatgtaaaataaggtgtgtcaaacatttcagtaaaaaagagtgctcaagaatgaagatactccaagtatatcagggtatataggcatggcacattcaaaagaaaacttgcaccacagaaactaggtctattctcagcgagaagtgattgtgtttaagacaaaaaacacaatgtgaaatacaatagaaatttcttagtttttacttttacagttttatttctaatacttataaattgtttattttacaggtataaaaacatacctttaagcatacacatttttatactagttttatctcagtgaatattaaaattataagaatttctcaacattgagtgtcactgattcttttttcttccaaaggaaacactgtttaaataaataatcaacgtccactgccactcattgtttaaatttggagaaataataagactaaaacttttaacaggctgatcaatcctttaaataatatttttgaacccttactatgtggaattgatcattgagccaattacacacagtctttgtcctagaggagttcatggtcctgcaaaactttccaaactacgtagggaggaatacaactaagagtgtcactgtctgctatttacaagttgtgagctcaaaagatgtggaaacaatctaaatgtccatcaacagaggcacggaaaaagaaaacgtgggatatacatacaataaattaccattcagcctttaaaaagaaaaaattccacatatagatgaacctggaagacattatgccaaatgattgcaacggattgctaagcgacataaaccagtaatgaaaaagataaacactgcatgattccacttatatggggtatcaaaaatagtcaaattcatagaatcaaggaatagaatgatggttgccaagggctgggggagaaggcaacgggagttactaatccatggttacaaggtttccattgatcaagatgaataaactttaccagtgtggtggtacccagctactcgggaggctgaggcacgagaatcacttgaacctggggaggtggagggtgcagtgagccaagatggggccactgcactccagcctgggcaacagagtgagactctgtctcaaaaacaaaaaacgaagaaaatgaaacaaacaaacaaaaaaccaaagggagggaaacaaagaaaaaagaaaaaaaatgaactcttaaaatctgcagcacatcattgcaactatcatactctactgtctatcatactctactgtgcactaaaaaatatgttagagtaggtctcatgttaagtgttcataccagtaaaattttaaaaagtgtgttttagtatgttacaaatgctctaattcacaatttatttatctgtaagatatgggtgataataataaaaattaattcagaatgtttctgtgataatgaaataattaatatagagtgaacagcccagagacaggtaatactggttttggattgatgcaccactttcactactctcattaaaaagtgattttgtttattcatatgcatatatacacagatatgtaaatatatgcacacacatacacacacacacacacacacacacacacacacacacagagagagaaagagaaagagataagccaccaactacttatggtccacttccttatgagtacatcatggcgtctactgcgtgtattactatagacgcattcaaaagaaaacttgcaccacaagaagggatgatgcagaacgttgaatattgctcagctacaaaaaaaagaaagtacgaggaatatttagaacaagtttttatattagtatctgtaaaaatatctggtaactaataggtactcagtagaaatgtattgaatgcgtagatgagagctaatcactgacactgagccagaacgtgttttgtcttatcaattgtgtaactgttttttaaatgatgaagataagtgaaagtccaaacaaagagttttcacagattataatactagaaattgtatctgttcactctggacttatcatgaataatactgtgagttaattttatgtttcaacttcactgggtctcagagtgcccaaatacttggtcaaacactattctggctgtgcctttgaggatgaattaggatgagattagcatttaaatcagactgagtaaagatgatagccctccctaatgtgggtgggcttcattgaatcaactgaagtcctacatggaacatatctcggcccctgcggagcgcgacccaccccccagaagcggttccactgcccacttccggtcctgtcacagactcagcgactgccagcgaccgctgaccgccccgctatggcaagtgcgccaaaactaccaccccgactgcgacgccgccgtcaacagccacgtcaacctggagctccacgcctcctgtgtgtacctgtccatggccttctacttagaccgggacgacgtgaccctggagcgtttcagccgctgcttcctgagccagtcgcaagagaagagggagcacgcccagaagctgataatgctgcagaacctgcgcggtggccgcatctgccttcctgacatctggaaaccagagcgtgaatactgggagagtgggctccaggccatggagtgtgccttccacctggaggagagtgtcaactacagcctcctggagctgcactacctggccatggagaagggtgacccccagctgtgcgacttcctggagagccacttcctgaaccagcaggtcaaggccatcaaagagctgagtggctacctgagcaacctgcgcaagatgtgggccacgggaaaccggcctggcagagtacctgtgtgacaagctcaccctgggccgcagtggggaggagccctgagcccagatgggccccacagccacggggtgccttcaccgggttgggccgccagacagggtgggcatgttgcccttccagaacgttctcttcagttttttcctttcagttttaccattgttggcaatacagttatctggttttcaaagcaataaaggtgtccagttgatgcgtgcctgcaaaactctcactatttaggaataaaggcacatcctcacacaagtttaaagttgatatccagcagtctctccacccagccctgccccatctgcatgcagctcaggatctccaaggttggaggaggaaggtattccatggggccctggaaagcacattagtcttccctttataaactacgtggatatatggagtgggatggggtgggatgggcagtcttgggccctggtgtctgggggtgcttgggcatcgtaaagtgtgaaacacggtccggaattcatccccacctctggggaagaagtgaggggaatgagattgggcagggattaaaatacacaaagaggtcttcatcttgacatgaaaacttttgtttcttaaatatgaaaatgttaacatttgttgattctaggtagcaagctggggatcctggaagatggcatgacagagtactctctgacaaactcacgctgagtgacagtgacttaatgggaatgggctggtttctccatagacttcgtagtaaatccctatagtcaccattgctgggcatctgtactatttcttccaataaagtcgttacatatacatatatattatagtaagtcctcagttaatgttgttgataggtttttggaaactgcaactttacacagaagaactggtaaggaaacccattttaccctaggctaattgatataaacaagaattaagttttgtggcatatttcccatcacaaaacatcaccaaacttgtaaagaaagaccaaattacttccagtattaaacatggaaataaatttgaattataagtacatttaaaagattgatagaaacaagtaaaataattatttatccatgtattccagttcagggggagagtggctggtgcatacctgggaagctcagggagcaaggccggaatcagtcctggccaggatgccatctcatagcaggtctctctctctctctctctctctctctctctctctctctcacacacacacacacacacacacacacacacacacacactcttacactgggacaatgtagacaccccaactcacctaacatgcacaactttaggatgtgggaggaaatgggagtacacggagaaaacgcatacagacatggggaaaacgtgcaaactccacacagacagtggcccctctggaaattgatttttttcctcatcaacgttataatgaaacaacgttgaacaaatcaatgttgaaggaacgatattcgagtatacttatatatgcatagatttaaattttgtttatatgtatttcttatgtatttatttatatgcattcattctaccagcagcgggcttcattttgaatctccagacaagattctgaatttttgcttaggaaggccacctttgttcaaagcagttcagtgactgtgttattgaaaatgatacatctgctttctagatcttttttgagcctggttttatttctgtgctcaggtttcatatatctaacttcgatttggttttctttgcttgctaccaagagaaacttagctaataaatctcattatcaatacacctttatcgggttctattgtaattatttatagtgaagtgaatggctcctctggggtagcaaatgacatttttcactttattcctaatagagtatgctgaaaggaaaaagcatgaaaaatgaaaaggaaaaaatagaaaaaattgtctccatgaaaatagaagtgaatgctgctatcacagccactccttatcacctggaaatgtgtttctatcataatttatggggttttaattccttaaaccagcttttcctttttttttttttttttttttttgagacaaggtctcaccctgccacccagggtggagtgcagtggcaccatcactattcactacagccccacctcagcctcctgagtacctgggactaccggcccacaccatcacacttggctaatctgtgtattatatgtagagatgtggttttctcatgttgcccaggctagtctcaaactccttggctcaagaggtcctcctgcctcgacctcccaaaatgctagcattataggcactagccactgcgcctggccttaaaccagttttattagactctgttccctatcatcatatcacacaaaatagcaataggtgttcagtgaaaaagtggatttgtggcaatattttaaatatatttgtatttatatataatacataattatatattttgtatatataaatatgtatcaatatttattaatatatatttatattatatataaatataaattatatatatgcagaacatatttgtgtttattaaattagcaaatttttttgctttgttttcagtttatattttttactctaggaattttcagtcttcaatataaaaatatattttgtgaatttacaacaggaggataaaatattcagcattttcccaacttcctaatcatgagatgctttttctaccaaattttacagaacaatactccaaagaaaataactccgtaaacaacatcaaagaatctcatggcgtgttattccagaagcatatacccggcagcttaacggctctttcactgagaagtcattatgcaaaacttgcttttgctgtgaaaattccagcacagtaaatttcaaagcaaaaagtggaattcaagcccctcagcatgagtgtgtgtagataacacccagaaccattttgtttcctgatggattactcctaacactatatttcttttctgttatcctctaattttcatttttaaatgaatggtttctgagaatgatgacattgatatttatctaatacttaaagttgagaggtggtttagtgctcccacatagcttatactccttcctttctctacctatatattcatcttatcagcaggaaagttcttccttttgattttccaagattgctcatttttggtcagtaatacatcctttggacaaaagcagtcagtgccttaactcttttggaaaacaaatacctgtttcttttctcaccaaagcatgctgaaattcctcaaaattctggcactgagctatgcgaaaaaaaaaaggcacatatggcttacagtattttaataataaagtcctggaatgttaaataaatatacaagtaatgtgcagcatcttatagtccacctctttcctccagtagagatcatcagcattttctatgtcactattcaattttgaatggacatcctgttgcagtgcattcctctctaggttcagtaaaggacatgttaagcttctctccagccctaaaatacatgttgtaattctataaattgaaactgcatttttcccaaacaatattgaacatgaagcaacacctaaccataaactcttgtagctgttttaatttaaatgtatcctcacagctacttttgggtatacttatattcttataattccaatgaatttgataaggtacttattttattcccaggcagacattaacataatacagaactattattttctaaatatggaaaatatgtaatcatttttataaatgattattttatcctagaaaataacaaggtgattaaaaatgctttttcacaagagcagcgtttgagtctggcctatcttactaaccacaactttcatttgtctgctgtttggctgtttaattcgattcaacaaacatttgttcttaataaatgagttggtgctagggagtcaaagttaaatgagacatggacttggcccagttaagtgagatgtattagcagtttgccaattttttaagagtaaaacacacatccaatatgaggttattttaatgaacaattaaatcaagagtgaatttaggaagtgttttcatttataattttccattcaatgtttattaaagagataatgctacacaatcattcaatgaactttcacaaacagtaatgaaataatttttacaaggtttgtggaagaacgtaggccagttactcttcgtatcaaaacagtggactctaaacaaatctaaagcatcatcgtaatgacaattatctgagtaatttataatatggaaataatgtatgaaggaactacctattcctgataatgaggggatgttacctaagggagagggagattttgagcaataactcaacacaatgtaatagatgagattttggcaaataaggagattacaaattggtttacatattttatgatatttttgccctgagacaaagaatgcacttggaagtatgttttcctcgtgtggatcacacaggagtcttctaagggactggtttaaaaatatgttttcaaaactagaaataagttatttctactgtggatatgaatctgcaagaaatctattggtaaaggtaatctaaaaaaaaaaatagggcttcctaaatgtcagctttttataccagaaaaaaatacaggtactagttaaagtcttttacagtatcatgacttgctttcactaatgaaaatagctcacagttattgagagcttgccatgtataaggcaccagcttaagtcatttatataaattacctcatttctgcctcacagcaacataaaatgtggtgctattgttatacccattttacagatgatgacagtgaactcagagaaattatattaattcctcatgtctcaaaactagtaagtggcagaggcgaaatttatctcaagacattttaaaatttgatttataatttctctgtttctccattggtggttcaggtgcatgctgtgtaatttccatgtatttatgaattttctaaaattcctattgttatttatttctacactcatgccattgtcagaaaagatatttaatgccatttccaccttcttaaatttgctaagacttctttatggcttaacattttatttattctggaggtattctctatgtgcttgagaagaatgtgtattctgcacaatgcagtacatctattggatgtactgcattgtgtatatctgctaggtccatttggtctaaggtgtagcatgtgtccagtgtttggtatttattttctttcttaaagatttgtccattgctgaaagtggatattgaattctcctactgttattgtattacagtctatctctctcttcatatctactaatatttgttttatatatttaggtggtctgatgttgggtgcatatacatttacaattggtatagccccttgatgaatttacccctttatcacgaatgaccttctttctctctggagggagttttttacttaaaactatttttttatacatatatgtagctgtttttgtcttttggtttttatttacatgaatatatttttccatcccttcacttttattctatgtgagtccttacaagagaagttagtatcttgtaggcagtgtgtgactcggtaatttttgttggccattcagccactctatgccttttgattggagaatttaatctcatttacaatcaaggtaattatcagtatgtgaggacttactgttgtcatttgtttattgttttctggctgatttgtagacacttcattcttttcttcctctattgctgtctttgctttgtggttaccacaaggcttacaagaaacatcttatagttttaaaaggctacattaaaaaaagttttattataagtacaggggtacatgtgcaagtttgttatataggcaaacttgtgtcatgggagtttgttgtacagattatttcatcaccaaagtactaagactagtacccagtagttattttttctgatcttctccctcttcccacactctgccttcaagtaggtcccagtgtttgttgtgcccctcttggtgtccatgtgttctcatcctttagccctcactaagtgaaagtataatggcctcaagctccatccatgttccttcaaaggacattatctcattcttttttatggctgcatagtataccatgatgtatatttagcatattttctttatctagtcatccgttgatagacatttaggttgattccatgtctttcctattgtagatagttctgcagtcaacatttacgtgcatgcatctttacgttagaacgatttatattcctttgggtatatacccagtaatgggatagctgggttgaatggtagttcagtcttcagctctttgaggaagcgccacactactttccacaatggttgaactcatttatgctctcactaacagtgtataagcattcccttttctccacaatttcaccagcatctgttactttttgactttctagtaatagccattctgaccggtgtgaggtagtatctcattatggctttgatttgcatttctgtaatgatcagtgatattgagctcctttgtatgtacttgttggctgcatttatgtcttcttttgaaaagtgtctgttcttgtcctttgcccatttttaatggggttgtttaatttttttcttgtaaatttgcttaagttccttgcagatgctagatattacacttttgccagatgcatagtttgcaaatattttcttgtattccgtaggttgcctgtttattctattgagagtttcctttgctgtgaagaaactctttagtctaataagatctgatttatcagtatttgtttttgttgcaattggtattggtgtctttatcatgacatctttgccagtttctaattccagactggtattgcataggttgtcttgcagggtttttatagtttggggatttcctttaagtctttaatccatcttgtgggttttttagtatagtgtacagtgtaaggaattttgtgtgtgtgtgtgtgtgtgtgtgtgtgtgtgtgtgtgtgtgtgaggaatgggttcagtgtcaatcatctgcatattgttagccagttatcccagcaccgtttattaaatagggtgtttttcctcattgtttgtttcgtctgctttgtggaagatcagatgtatgtaagtttgcagcattatttcttttttatatagcataaggaacgggtccagtgtcaatcatcggcataggtctagcccgttatcccagcaccatttattaaatagggtgttgtttcctcattgtttgttttgtctgctttgtggaagatcagatgtatgtaggtttgcagcattatttctgggctctctattctgttcctttgttctgtgtgtctgtgtttgtaccagtaccatgttcttttagttactgtagccctggagtatagtttgaagtaaggtaacatgatatttccagctttgtttcttttgcttaggattgctttggctaattgggctcttttgtggttccatatgaactttaaaattttttttatagttttataaatgtacttttaggaataacatagattctgtaaattgctttgggcagtatggccattttaacaatatttattcttcctatccatgagcatcaaatgtttttccatggttttgtcacccctgatatctttgagcagtgttttgtaattcacagagtggagatctttcacatccactgtttgctgtatttgtaggtattttattctttttgtggaattgtgaattggattttattcctgatttggctctgagcttggctattgttggtgtgtaggaatgctagtaatttatgtacattgattttgtatcctgaaactttgctgaagttgtttatcagcttaaggaacttttggtccaaggctaaggggtttttacatatagaatcatgtcatctctaaactgggatagtttgacttcctgtcttcctatttggatgacttttatttctttctcttgcctgattgctctggacagaacttataatactacaattgaataagagtgatgagagagggcattcttgtcttgtgccagttctcaaggataatgcttccagcttttgaccattcagtctgatgttggctatggttttgtcatagatggctcttattattttgaggtttgttccttgaatgcctagttctctgagagtctttaacatgaagacattttgaattttgttgaaagccctttctgcctctattaagatgatcacatgttttttgtcttttgttctatttaggtgataaatcacatttattgatttacatatgttgtaacaatcttgaatcccagggataaagcctgcttgatcatggtggtgctttttgatgtgcggctgtgtttggtttgcggtattttgttgaggatttagcataaaagttcatcaaggatattggcctgaagttttctttctttattgtgtctctgccaggttttggtatcacgatgatgctggtctcatagaatgagttggggaggaattccttccactcagtttttcagaatagtttccataagaatggtacaatctcttcatcatacatctggtagaattggctatgaatccatctggtcctgggctttgtggggttggtaggatatttattagtgattcaatcttgttgctcatttttggtgtgttcagggattcaatttcttcttggttcagtcttgggagagtgtatttcttctagattttctagtttgtgtacatagaggtgttctaactagtatctgatgatgatttgtattaacatatttctatggagtcagtggtaacatcctttttgtcttttctaatcatgtttatttggattttctatcttttctttattaatctaggtagcagcctatcatattttttttcaaatattcagctcctggcttctttgatctttttaatggttttctgtctctcaatctccttcagttcagctctgattctggttatttcttgtcttctgctagctttggggttgttttgctcttgttcctttcagttgtaatgttaggttgttaatttgagatctttctaatgttttaatgtgggtgtttagtgcaatatatttccttcgtagcactgccttagctgtgtctcagagattctgctatgttgtgtctttgttctcattcgtttcacagaacttcttaatttctgccctaatttcattatttacccaaaagtgtttcatgagatgcttgttgaatttccatttaattgtaaggttttcagcaattttctcagtctggatttctatttttattgtttgtcatccaagagagtgtttggtatgatttcagttcttttttatttgctgaggattgctttatctctgattgtgtggttgattttagagcatgtaccatgtagcaatgagaataatgtatattcgttgttttggggtggagatcttcataaacctctctcaggtccatttggtccagtatataatttgaattatacttctgtcatttcaggcatctcagctcagttaagaacccttcctatagaactagtgttgttgtttggagaatagaaggcactctgacttttcgagttgttagagttcttgtactggtactttctcatctttgtggactgatgttccttcagtctttaaagttgctgtccttttgtttttgttctattcctttatcctatttgattcccttgggagtttggtagtggtataatgtgggttcagtcaactggctttatttccgaaagattttagttgtggggtgaggctcaactcaggaatcctgggctgcatgccctaaccctgggtgaatgttaccaatcctggatttcttctctggcccctcaaagttgggaagctgtgctagaggggctgaggtgctcccaggctgctggtcacaacactccaatgggtagtgccacccaaagcacttagtagggaggtggcagcagtaccagtttttgtttgctcatgccagtgacagtgcagcaggatactggcctctgtgcagattttcacagtagtggttggtgttagcatggcacagcagggcgtggtgccccctactagtgtctgtgtgagcatttgcgcctgtggtggtgttagcatgagggcagggttctggtgggctcagggctgtgtgcgccctctgttcactatcacacgggtggctgtggctgtggttgctcagggtgagggtgggtccgctggtctccatgcctagttttacactagtggcagtgttggcacaggggttaggtgctggcgagggtgaggctggtggattccatgcccaagaatgctcctacagcgataacagtgcagtgggggtggggagcagaatgcactaacactggcagcagtggcacagcggagtgcacatgcacacatgtgcttgcagggaagggaaggccaggtccttttggacacacgtgcactggcaaagatatttgggggtggttgtgggcaagtgcatacaggcaaattgccacaggggaggctgcagtgcaggaagtgctgactggctggtgtgtgtcctcaggtgctgctctgttggagctctctgtctgtgaggtgcattctaccagcacaggagctatgatgtgggaccccaggaggtcctcctcccctgggcacctgagactgcacagcaagcaggtatggcctggctaggactcctgggagaggccagcagactgaggggtgctcaagtcagaccagccccatctcatgagcatggccaccgtgtggagttgagatctgtcagttcccctaggactaaagtctcctatggcagcaagttgagcctagggaaatgggtgtccctgcctatactccattacagacattcccgcaacaaaccctctgggctcacactggctggagttccgccccgccccttctctaagcagctctctctgccaactcaagtgtccatggtggtcataatttatccttctgtcaggattgcagaggctcttggtgagagtgagttgctccctgctaaaaaaggatattttaatctgataacaacttaactttaattgcatacaaaaactttacacttttactttctcacacattaaaaatgtttgctataaatagctcttattattttgagatatgttccatcaacacctagtttattgagtgtttttagcatgaagcggtattgaattttactgaaagccttttctgcatctattgagataatcatgtggtttttgtcattggttctgcttatgtgatggattacatttattaatttgtgtaagtttaaccagccttgcatcccagggatgaagccgacttgattgtgctgggtaagttttttgatgtgctgaggattcagtttgccagtattttattgaggattttggcatcgatgttcatcagggatagtggcctgaaattttctgtttttgttgtgtctctgccaggttttggtatcaggatgatgctggcctcatgaaatgaattagggaggattccctctttttctattctttggaatagtttcagaaggattggtatcagctcctctttgtacctctggtagaattcagctgtgaatccgtctggtcctggactttttttggttggtaggttattaattactgcctcaatttcagaacttgttattggtctattaagggattcgacttcttcctggtttagacttgggagggtgtgtgtgtccaggaatttatccatttcttctagagtttctagtttatttgcatagaggtgtttatagtattctctgatggtagtttgtatttctgtgggatcggtagtgatatcccctttatcactttttattgcatctatttggtttttctctgttttctcctttattagtctggctagaggtctatctattttgttgatcttttcaaagaacagctcctggattcactgattttttgaagggtgtttcatttctctatctccttcaattctgctctgatcttagttatttcttgtcttcttctagcttgtgaatttgctcttttttctctagttcttttaattgtgatgttagggtgtcgatttcacatctttcctgcattctcatgtgggcatttagtgctataaacttctctctagacactgctttaaatgtgtcccagagattctggtacgttgtgtctttgttctcattggtttcaaaaaacttctttatttctgccttaatttcgttatttacccagtagtcattcaggagcaggttttttagtttccatgtagttgtgcggttttgagtgagtttcttaatcctgagttctaatttgattgcactgtggtctgagaaactgtatgttatggtttatgttattttgcatttgctgaggagtgttttacttccaattaggtggtcaattttagaataagtgcaatgtggtgctgagaagaatgtatattatgtggatttgaggtggagagttctgtagatgtcaattaggtcctcttggtccagagctgagttcaagccctgaatgtccttgttaattttctgtctcattgatctgtctaatattgacagtagggtgttaaactctcctgctattatcgtgtgggagtctaaatctctttgtaggtctctaaaaacttgctttatgaatctgagtgctcctgtattgggtgcatatatatttaggatagttagctcttcttgttgcattgatccctttaccattttgtaaagcccatctttgtgtcttttcatcttttttggtttaaagtctgttttatcagagactaggattgcaacccctgcttttcttttgctttccatttgcttggtaaatattcctccatccctttattttgagcctatgtgtgtctttgcacatgaggtgggtctcctgaatacagcacatcgatgggtcttgactctcggtgggagtgtaaattagttcaaccattttggaatacagtgtggcgattcctcaaggatctagaaccagaaataccatttgacccagcaatcccattactgggtatatactcaaaggattataaatcgttctactataaagacacatgcatatatatgtttattgtggcactattcacaataacaaagactcggaaccaaaccaaatgcccatcaatgatagactggataaagaaaatgtggcacatacacaccatggaatactgtgcagccataaaaatgatgagttcatgtcctttgcagggacatggaggaagctggaaaccatcattctcagccaactgacacaggaacagaaaaccaaacactgcatgttctcactcataagtgggacttgaacaatgagaacacatggacacagggaggggaacatctcacacctgggcctgttggggggtcgggggctaggggagggatagcattaggagaaatacctaatgtagatgacgtgttgattggtgcagcaaactatcatggcacatggatacctatgtaacaaacctgcatgttctgtacatgtaccccagaacttgaagtataataataaaaaattttttgaagtttgatatcacaatttatatctttgtatattgtgtatctgtgatgattaatattaagtgtcaacttgattgagttgaaggatacgaagtattgtttctgggtgtatctgggtgtttatgggtgttgccagaagagattaacatttgaggcagtggactgggagaggaagtctgccctcctccccaggaagacccacccacaatgtgggttggcaccattcaacctgctgtcagcatggctagaaaaagcaggcagaaggaggtggaagaacctgaattgctgaatcttctggtcttcatctttctctcatactgaatgcttcctgccctcaagcatcagacccatgttatttggcttttggacccttggacatacactggtggtttgcaggggttcttgggccttcaaccacagaatgaaggctgtattgttggcttctctactttagaggttttgggactcagacagagccattacgggcttccttgctcctgaacttgcagatggcctattgtggtacttcaccttgtgatcgtgtgagtcaagtctccttaataaactccctttcatatatatatatatatatatatatatatatatatatatatatatatatatatatatatcctattagttctgtccttccagagaaccctgtctgatatagtatcccttaacaaattataatagctatttttatttttaatagtttcattttttaactttcatactaaagaataatggtggtcatttatatgccaccattatagtattataatggtatattaaatttgaccatctactttctttttccagtgagttttatattttcatgcttttttgtgttactaatttgcatcaggttctttcagtgtgtagaagtccctttagcatttcttgtaataatggcctgattgtgatgaactctctcagtttctgtttgtctggttaattcttcatttctccttcattctggaggacatctttgacagatacagttttcttggttggcagttttttttttttttatttagcacttttaatgtatcatctcactctctcctggcctataagttttctgcttataaatctgctgctaaccttgaacttccttatatgttatgtccttttcccttgctgctttcatgattctttcctttgatttttgacagtttgattataatatttctttgtgtcgtcttgtttacattgaacctgtttggaaacctttggtctttctttagtgggatatttatatatttctccaaatttggagaattttctgctattatatctttaaatgagctttgtacatctttttcttttctccttacattgatgcctgctctttcgaaaacatgggcaattattttagtctttataaactggctttgtctgggacagccctctgccagtcggcccatccagagattctgagcaagctgcctgcatgtctggaggtaggcttgctgctggagtcattgtgcagcctggcctgctgccttggtcagcaggtgggaaggcctggcacctgggtctgcagtgttggtcctgaatcctggattcattggggtggacctgttaattgcatctgtagagatgggactaaagcctgagagcatgagaatggcccaaaacccagtatgtgtggaggctggcctgaagtctgggcccacaggggctgatatgacatgggggtgaacccttaactttagtcctcaactgctggcctggcagtggggtgtgtctgtaccctaagtctgcaatagtacatgtgggtcttgagtccataagggctagactggagtctaggttttcaggggtgttcatgcagtctcagttcataggattcaacctgacaaagcagtttcctggagtggttctgacctcgggtttgctggaacaggcctagacctgtgtcttctggagcctgggtatgacctgatgctggggctggcatggagcctgtgtctatgggggctgccctggagagtatgactgtgggtgttagcctggatcctatgtccactgatgctggtctggagacttgtgcaggtgctagcctagaggctaggtctgtgaaggcttgccctgtgggggatggccagggacctgggtacacacatgccagtccagaattgtgatctactgggaccggcctggatgctgggtctgctggatcaggcctaatccctgggttgctagaacatagtgccacaggtgccagtctggagggttgggccacagagaccagcctggcactgggaaggcatggaatctatgtctctgagtgtctaccttgtatttgaagttgggctgctgacttggtgctagggcaggtctgaagcatggggccatgagggccacctcagtgctgagaatagtccagagcctggggccactgggttcaggctggcagtggggtggctctgagacagactccatctagtatgcctagaacctgaagctacaggatctggcctcgagctgaggtggctggaggctcagacacaggcacctgtgtagagtctggggccctggggttctgcctagcactgggttttactggggaattctcagtgttggggtccaaagctaggaccattgcttacttccttccccttcccccatatggagggtatctctttccatactgtgctacctcaagttggtagagaggtaatgagggtaacgtgaagctattattcctactctcatcaatgtgacttttcttatttctttgatatactaaggcgctataatctatcacctgtcatttctgaagatatatttgtacatgataattgttcctattggtgctttcgtaggggcacaagtgctagacagtcctatttgctgacatctgtcccttcgagcttgaatttaaatacatgccatctaacctgagatcgtggacacttaaccattgttctatatggtaatgagtaaatcggaaatttctaagccctatgattatgacaatgtgacatgatctgttgtgagaagttagtaggggagagatcctagaaggctgatttaacagaaatctcagtccagtgagatacaactacaacaggttcaatcagttaagtgccaataacacagattgagatgaccgaaagtctgaaaagtcaaggatttgggggatttgtctaaaaagggcagttaatttgaacatagagccaatgcatgtcgtcttctgctttgtactaaagtaattgcacaggtcttaaaaaggtgaactgtggctttgattgagcaggagtaagctgctgggatccttttaagaacttcgttagagatatacaataaagatagaaagattaaatgtaaataagaaggggttattttagatggctagtagatcaaacatattttaaccagtcaatataatacttaataaaaaataaacagcacatgagtgaacatggatttttcaatccaacattctgtgattagtaacagagtataattaacatgttgctaccaatctgaaactcacattttgagaaaagcttttcaattccttcactcctccagaggactctaggagagtacaaggaaacatgttttttttttctttttgctacattctcccaaagtttgcttttcttttttctagttctaaacatcatacagttgaaatgccaactgtataatgttagtcatcattcagttattatgttactgttagccaatgaagttagaaaggatgaatttgtgacaggatacatccacatggttaccaatactttctataaaaatgaatctaaggcttttgttttctgtcagagacaactaaattctgtgcttacccaagaagaggcaattcacaatgtaggtgaaaggggtgagcaaatctgggagaccaaggaagagatattgaaactgtctattttggggttcatacaggatagaaggtacatgtgtataggattgtaatgaagattaatagactagacagaacaaaggaggtgaagaacaagttcacaaagagtgagaaacatggaaaggtggaaatattcactctgaaatttgggtggtggtgctctgctgtcagagaagtggaaacttaataatgagtagaaggagaaaagtggagattgctagagctaataaggtctaggaagtaagtcaggaggttatccaaagtgttattagcatcaatgtggactcttctttctgtatctaggcaatctgctctgtgctgtgaattccatgcctgcaagatgccaagaccttaaataataattatatgatacataataaattgactacatttccatatcactttataatgtgatgtcacagtggacaatatctctttcttctcaggagcccattcattcagatgttttctcttcttctctgtgaaagcatcttaagactgtgaaagatgaagtcaagatattagatattaaaatattaagacgtttgcaacattggaaaatttgtgtatgatagtatcttttgggtttgagtaaaatcattttgaaattggcatgttgaaaacatacatcatctcactgatttggggcctgagggtattaagaataaatggaacataaaatatatatgaatgggttttttaaagaaagcaaggagttctgggattggacttcactccttcaaatgattttcatgaactcatttggaagacaaatatttatgtttagtcttaggtaactaagtccgtcaagccatagaacagcagccaccaacagtttgtcatggccaagcagcagcagttcagtggctctgagtggtgaaaggaacatgacatgagtgtgtttatggagattccagaactacattcttaatgctacctgagtcagcaattcatttgccaattgtataaaatccccaagtactgctgatttatgtatgtatgtatgtgtgtacgcattttattatactttaggttctgggatacatgtccagaatgtgcaggtttgttacataggtatacgtgtgccatggtggcttgctgcacccaccaacacgtgatctacattaggtatttctactaatgctatccctcctcttgccccccactcctgaacaggccccggtgtgtgatgttctgctccctgtatccatgtgtactcattgttcaactaccacttatgagtgagaacatgcggtgtttggttttctgttcctgtgttagtttgctgagaatgatggtttccagcttcctccatgtccctgcaaaggacatgaactcattcttttttatggctgcgtagtattccatggtgtatatgtgccacattttctttatccagtctatcattgatgggcatttgggttggttccaagtctttgctattgtaaatattgctgcaaaaaacatacatgtgcatgtgtctttatagtagaatgatgtataatcctttgggtatatacccagtaatgggatcactgggtcaaatggtatttctggttctagatccttgaggagtcaccacactatcttccacaatggttgaactaatttacactcccaccaacagtgtaaaagctttcctatttctccacatcctctccagcatgttgtttcctgacgttttaatgatgaccattctaaaatgtgcaagatgctctctcattgtggttttgatttgcatttctctaatgaccagtaatgataagcttgttttcgtatgtttgttggccacataaatgtcttcttttgagaagtgtctgttcatatccttcacccaatttttgatggggttgttcgtttttttcttgtaaatttgtttgagttctttgtagattctggatattagccctttgtcagatggatagattgcaaaaagtctctcccattctgtaggttgcctgttcactctgatgatagtttcttcggctatgcagaagctctttagtttaattagatcccatttgtcaattttggcttttgttgcaattgcttttggtgttttagtcatgaagtctttgcccatgcccatgttccaaatggtattgcctagtttttcttctagggtttttatggttttatgtttaagtatttaatccatcttgagttaatttttgtataaagggtaaggaaggagtccagaatgactactggttaaataacgaaattaaggcagaaataaagaagttatttgaaactaatgagaacaaagacacaacgtaccagaatctctaggacacaaataaagcagtgtctagagggaaatttatagcactaaatgcccacatgagaatgcaggaaagatctaaaatcgacaccctatcatcacaattaaaagaactagagaagcaagagcaaacaaattcaaaagctagaagaagtcaagaaataactaagatcagagcagaattgaaggagatagagaaatgaaatacccttcaaaaaatcaatgaatccaggagctatctttttgtaaagattaacaaaatagatagacctctagccatactaataaagaagacagaaaaatcaaataggcacaataaaaaatgataaagggaataccaccactgatcccacagaaatacaaactactatcagagaatactataaacacctctgcacaaataaactagaaaaatctagcagaaatggataaatttctggactcatacacactctgaaaactaaaccaggaagaagtccaatcccttaatagaccaataacaagttctgaaattgaggcagtaattaatagcctaccaaccaaaaaaaaaaaaaaaaaaaaaaccaggatcagacagattcacagctgaattctaccagaggtacaaagaggagctggtaccattccttctgaaactattccaaagaatggaaaaagagggaatcctccctaactcattttatgaggccagcgtatcctgataccaaaacctggcagagacacaacaaaaaaagaaactttcaggccaatattcctgatgaacatcgatgccaaaatcctcaataaaatactggcaaaccgaatccagcagcacatagaaaagcttatccagcacgatcaagtcagcttcaaccctgggatgcaagactggttaaacttacacaaattaataaacgtaatccatcacataaacagaaccaatgacaaaaaccacatgattatctcaatagatgcagaaaaggctttcgataaaattcaacacaccttcatgctaaaaaacactcaataaactaggtattgatggaaatatctcaaaataatgagaactatttatgaaaaacccacagccaatatcatactgaatgggcaaaagctggaagcattctctttgaaaaccggcacaagtcaaggtgccctccctcaccactcctattaaacgtagtattgaaagttctggccaggcaatcaggcaagataaagaaataaagcgtattcaaataggaagagaggaagtcaaattgtctctctttgcagatgtcatgattgcatatttagaaaaccccatcgtctcagcccaaaagctccttaagctgataagcaacttcagcaaagtctcaggatacaaaatcaatgtgcaaaaatcacaagcattcctatacaccaatagcggacagacagaaagccaaatcatgagtgaactcccattcacaattgctacagagaataaaatacctaggaatacaacttaccagggatgtgaagaacctcttcaaggagaactacaaaccatgctcaaggaaataagagaggacacaaacaaatggaaaaaacattccatgctcatgtataggaagaatcagtattgtgaaaatggccatactgcccaaagtaatttatagattcaatgctattcccatcaagataccattgactttcttcacagaattagaaaaaaactactttaaatttcatatagaaccataaaagagcctgtatagtcaaggcaatcctaagcaaaaagaacaaagctggaggcatcacactacctgacttcaaactatactacaatgctacagtaaccaaaacagcatggtactggtaccaaaacagatatatagaccaatggaacagaacacagccctcagaaataatgccacacatctacaaccatctgatctttgacaaacctgacgaaaacaagcaatggggaaaggattccctatttaataaatggtgttgagaaaactggctagtcatatgcagagatttatttttgtaatatgggacataaaattcggtatttattgaggtttaaaatatccatctatgcttatcaagctaaatacattgacttttacattgtaattataaaatgtgtaaatgtgtatcattgttcttacttgataataaaatatttggttatctcatttttgttagagcagagtaatgtatttaacattaaatataaattagaatctaaagtctacagtgggaactaaaatcactgttagaatttgaaaaatgaggtaatatttatgatattatagctatttattactgggcttcctattcaaagacaattctgctgatggtgattataatcttttaatgatggtatgattaagatgcaaatgtgtaaatagaaatgtaaggttatcttgcagtatcttctaatttttttgactaccataatatttttaaagatgttctgttagcaaatgtatattgttattacattgacacaaaggaatatattaacacagaagagaacagtggcacaaaaatctatctactatttggattctgtatctaaaacaaaaagattattttacattaggcaaatttaatagttctttttatttttaatactatgaataaaaattattttatatgttatatgcagtacatatatgtgagaaaaaatatttctattctttctcactctgacgttcaattttaaaatattgagattaaatattaagcatcagttgtattttcttaaaattttataaaattcattggtatcataaatgggaaaaaattacaaaagtaaaaataaccataaaattaaggaagttatttcttacaaatatgactcttcctcatacctattttagaatacataagtaagaaatctcttctcttaaatatctatataagtcactcttattattacttgttaatgacaatgtacttttatttgtaactatctctaagacaaaatagattatatattgacttaaatatgtcaagggaagacttcccatcaaaatattagatctcttccatttctccaaaggcttctttgccaattttagtattagacattagtgatttacctatattaattatcattcatttacccacatataacttactgtttcattatttactgaaatatttatcttcacataatacagccatgaaccgcataacaacgtttgggtcaattgcatatttgaaggtgttcccataagattataatggggctgagaagttcctatcacccggtgatgtcttgatgaccttgactttgtgtagacctaggctaatgtgcatgtttgtgtcttcattttcaatagaaaagtttacaaattaaaagtacataaaaaatttcaaaataaaaaagcttataaaataataatataaaggaagaaaatatttttgtactgctgtacaacgtgcttgtgttttaactgttattatcaaagaatcaatttttaaaaaattaaaaattttataaagtaaaaatgttacagaaacctaatgtgatttattactgaaaatgaaaaatatgttttaataaatttagtgtagcttaagtttaaagtgttttaaaggtcttcagtaatgtacagtaatgtcttagcccttcaccttcactcaccattcagtcactgattcacccagagagacttccggttctccaagctccattcatgatcagtgccctatacagtatacagttgtatcattttaaaaaatctttaatagcatatttttactgtaccttttctatgtttaggtatgtttagacattcaaatacttaccattgtattaggattgcctccagtatgtactacaatcacaagctgtacaggtttgtagcctgtgagcaataggctataccatatagcctagatgtatagtggactataccatttaggtttgtgtaaatgcactctgtgatgtttacataacaacaaaattacctaacaatggatttctcagaatgtatccacttctttaagtgacacatgactgcactgtttatgaaatatattccttagtatctatttgaatgtaatggtatatcaatgaaataaactgataaatctcttgactgataaagtccattgtgacacaagtgtctattgccaaggtgccttgtgtcctctagcctgctggagtcaccttgggctttaagattgaaataaagcaagtcacatatcacgctgtataaaatccagtgtccatagcatctctgaggatctttggaaaactcatttttcttcctcatctctggttttattttcttgccccctttatcttgcatgtctcatttgtatcttaccttttgttaaagccatccttccacatactgacgtccaaacgtatctgcttcctagacaattttggcagcccaaattgatgcttcattatacatagtaattcggttatctttatagtctcccagagagtgccctaaagatctcttctatcatgttcacagcattatatcaaggtattttccgtaacaaagggctatacacagaatgagaatatgccacaatcttaggaggcaaacatatctgtagcctgctatgattttaaatagtatttttctcagctacacatttaattacttgatactatgacacctttgatggtaaaaaagcatcacaaaattagtgacagttttaaatgagcaaaagaacaaaggcctaaaagaagaatatttttacattgactacattttgtcgcaaattcttgtagaagtagaatttgccatggatcttcccactccaattccaacaaatctttctgctacactattagagcaatttagaaaatatgagatgtaaaacctaaaataaagtatttatgttagctacaaacaacgtgacaagagcatattcagtggttgagaaatgtaatctcaagaatatgtgtgttcaagtgacacagaaacttgataatgtcatttctgatagttgttaaggaaatgcttcactgagagtggaatatcaaaaatgattgactatgaaaaagaaaaactgaggtgaacattttggaagggttattttatcaaaaagacataagatacgcaacattctgtacgatatttttttctttgcaaatttcaagttttagatatggggggtacatgcacaggtttcttacatgagtatattatgcccaggtatattatgcctacttaaaagtgagtacatgtggtctaaattaaaattgtgtatttatatatagactgtattccatcattataatagtctatccttattcgtgaggaatatattccaagacccccagtgaatgtccaaaagctcagatgataccaaatcttataagccctctgttttttcaatcttattactgagatagctactaagtcattagccagaggatagtgtatacaacatggataatctggacaaggggatgattcgcattccaagattctagattttatcatgctacacagaacagcaccgaacttaaaaagtatgaattgtttatttatgaaatttttcatttaatattttcagaatgcagttggctgcaggtaactgaaaccgcataaatggaaaccatggataaggggagactaatgtatatagattttgactctgatgctcttctacataacctaatcatcactggaatagtgtatcattgtggaattggttgtattttattccccttgtttccaataacattactcaaggatgtagtaagaagaaacaaattgtgagggtgtgctctgatagaaaaatacacgagtataacaagccacaggatacactagatgcattgccatatgatgctaatgttgagaaacattttgcctctctttgatataattatagttcgaaaatatgttatgatatttaaaaaggaaaagcagctgcttaaaaatcaacctctcatggcaatctctaagattcttacagttctgtagctcattgtttttaagttattgaatttgaagatataatttcaactgaaaattaaaaagcctcaagaatggagagagtagactcttattgaatgtaggagagccaaaagcaaataataaaaactgcttgattgagcatggctattggacctagaagaaacctctctgcttgctctttgcatgaagaataaaatataagaacagtaaaatagctcatctgtagttgtagaaagttctaagagactcctacctgacccaacttccaaggtctctgagaagccctgaaatcagacctggttaccttggctctgctgacttccagcttgaccactctgtaatataattatcaactttaataacagtttcttgacatgttcacccaggatattaagaaaatttacaaagtattcaggaagcttttcaaaatctagacagttacattgttaatagttcaaaattaacctattttctatcgtccacctaaatttattttgagaaattttaatgatttcctttaatttagcaattcagacaatacaatactgaataaataagggggcaggttcatcaaagtctgtggcaaaatacagagaaggtagattctaaaaggctgctcaaaacctttaaagtttttaggtatagtagattctaaattttggaccataataatcatacatttctttttaaaagctatatttggtaaatcatcacaatgatttttttataatcacactatttggacatagaacagaatataaagtaatataagataaaacacaattttcaatgcacagaggtcaaatgttcattccatagatgttgaacataaagaggagaaataagaccaacagtcttcagatgtttaaatgtaataagaaattaaagactgattatttcactggatgttcagctttaactggataacaaacacttttaagcattttatgaaatcaaaatatttcataattttaaaaaaatgattttaatatttgaggatggatcttttttatatgaggtatactataatacctttcacctgaggtgggtgttattcggcaccatattgctttatttttgtttttttgtttgtttatttgttttggacgcaagttctcactctgttacccagactgcagtgcagtggcagaatcacagctcactgaaacctcaacctccctggctcaagcaatccttccacctcagccttccaagtagctgggactacaggtgcacaccaccacacccagctaacttttgtcttttttgtagagatggggtctcactatgttgactgggctcatcttgaaccgtgggctcaagtgatccttctgccttggcctcccaaagtgctgggattatagggatgagccaccgtgcacagcaccatgttcatttttcatgtgtgaaatcatcaccacatccttctcttagaaagataatgagattattataggtagcatgtgtgaagctcattgttttctccatattctctcctctccctaccattttcactgtactagaagttgttatgagggaaataatgcttttcatccatcacagatcctgtttcctgtttctgaaggttgccaagtaaacagggacaaaagtgaatctgctctcctgctctctggtctgtataggtgcttcagatgcaaaaggagctgctaccagatgcttgtaggtgtcccgagcagattctagccaaactgtgttgtcccttcatgtaactattctttaatatctattgcttattttgttataaaagaactcaaaagtggtatgtggaaaagagctgacaaggaggactagtagaaaaagaaattcaaccctggtctcacatttacagactctattcaataaaataaattcatgcagttgaccatacctactctcctaggaaggctaggttagtgaccacgcattgttatgtgaccatgacccctgaaagtcaagtgtccaccccaagtactttattatattttcctttcaaccatatatatgatttttcctgaaagaataatggtaaatataaagtttcccatcttgcaacattaaccgtgatgttgttctctagtatctcttattgatgtctacctcttgtaagtatcctattgatctcctctttaatccattcttagagttgaataatccgttgtgaccaagatggctatgtcatgcttagttgtgagacattttctaccctctggatccatattacaggtaagggaatttctgttccagtctctccaatgctaaaatgacctgggagacagaacagagatggagaagactatgtataaagagcaggtgggccttccttcattctggagtggtctctgacacaaacatttagttaggagttaaagaatatcaagtatgaagaatatgaagccgacaaagtctcaaattgatgacatacttcttcattaatttatggctaggtagtctgggcatggtggctcatgcctgtaaccctagcactctggggggccaaggcaagtggatcgcttgagcttgggagttcaagaccaccagccttgccaacatggcaaaaccccatttctataaagaatacaaaaagtagccgggtgtggtggtacgctggtagtcctagctacttgggagactgaggtgggaggattgcttgagcccaggaggctgaggctgcagtgagctgagtttgagccactgcactccagtcagggcaacagaatgagaccctgcctcaaaaaaaaaaaaaaaaaaaaatctatggttaagtgagtcttcattgccttgttctgcttggcaaaatggtgatttctaactttggataaaaggacccttccttcttggcagggaataaaggacaaaaattatggttcaaactagcaaacttagaaaatataacacacaaaaaagagcaaggttatttgtatatttccctttttaaatgtttgtctctcccactggataataagctccatgaaaacatggacagcattggttttgttcactatcgtagccccagaatttggaaaagtgcttggtacatagtaatttttcaatgaatatatgttgaataattgaataaatgtcatctaaacaaaaattttgaagacaaagcaaatgtgactagcttaatactttagaggaaaatattactttggtggaaacaaaatcccataaatgttttcacatgaacatttgatagcacagaggaaaaacacctaaggaaaagagagaaagagaatggcttttataggttgtgcttctgggaggtaactcttaaattggtatttgattgcagtttagtttggagtaacttctggataaagaacacaggcaaaatatgtgatacagcatcaataaagccctcagcttgtgcccggggaagccctggagctggaaatagtcttgagaattggcttgaatcggggaaaggggacatgaactttatacctgctttacccccttgcatttcccagttattggatgtgggttatccttggaagggtgagcatgtgacacacaggaaagcagtacactgtagcagagggaaaggccttgaaacaaacacagtggcagactgtcagcaaccaacacttaacagcagcaagaagaatgagtgattccacctgaagggacaatctggacactgcctgaaagcggtaggcttcagagagggtgtctaagaactaggtcttggggataaaaatgatatcattgaataatgtcagatactccaacaacaacaaatacacattagcatgaagtgtaatgataggctgaaggaaacatgagtagaaatgatacataatatctattattataatatgatgatgatgacaaaagtaaaaagcagttagtagtggtaactatgtgtcaaaagccatgcaatttacatatgtagtagagtcaaatattatttatggtaaccagaactaaatttactaatgcatgagtatcatgatctttctttttttggccagattactataagcaaagagtcttactttatccatatatgtccccagtctctccttttctgtaaaagaaagtctgacaactatataaagtgggtataataagaacattttagaaatggagagaatactggtttctggagagggcagggaagggtagagtgggaaggcgtattgtggttatcaaagggcaagagacaggattcctgtggtgatgaaactgcttagcatcttgactgtagtggcagatacaaaaagctacacatctgatgaaatgtgataaaattaaacacactcacatgtgcaaacacacacaggagtatgaataaaattaagaaaatctaagcaaaatgggtggattgtatcaatgccaatatcctggtttgatattgtactatgcttttgcaagatgtgtatccacaaaagtttttaaaaattaaacaattaaaatatcatgttatcattgtaggaaactgtgtagaagatacatcaaatatgtttttattatatcttacaataataaagtgatttacctacttacagtaagttatgtaataattatttcaatgaaactttcaatgtaaaattacaaacatactactagtgggtatttttaaagattatgttgcatttgggttcatattatcacctactgcaataaatttggaatcaactaaaatcaatgctgttggaagtgttaaagtattatctagaaaacctgcttagttcttgcctatttcctccaggtacccaactcattagactgatccctaccttctgccaccagttttacaagaatttaaatgtgatcactgtctgaaaaaatgtgatcattttgaccagcatgcagaatttagtgagaaatctattaaggggagtagaagaaggcagagtgcctttaagaataaaaacaacaatggttcacataaattgaacacttattatgtttctgacactgtgctaattttatgttctttgacttttaaatcttaacaatatcttaaagtacctcttattactgccattttacagagagattgcatacatttctaagtgcatggagctatgagaggcagaagtgggattaatattcacatcattttctaagcttcagatctttgcttctatgatatatcacatataaaatatagctaaagagagctcaggacaaaggatgacggactgtgccttaactataaatttggtgaatccaggtaggcatactgaaggcttagggggaaaatcattcagggtaagggatctaggcaataattcagaggtcatctatccttgcattttaagaactctccaagaagagaaaccattattgtcaaatctccaggaaatggaaaatagtcattgttgaaaaatatatggttttctatccttctgcaggctttttctgttggaactttaatataaatataagttttatctgatttgaattacagcttatggttgtaatttgagagaattgtggaagtctagctgggacaatccttgaaaaagccattattgcccattttattcacaaagggtatagtcacctctactatagataatctaataagaacattatgactgcagatatcatgtgtgagacgtgtgttagtatagatacaaaccagacacacaaatattactttttcattctttctgttcacatctctgctacctccctcatttatttcccacctcctctttcgtcctcttctgtttctgaaaacctcttttcattatcattctcttccgtaatttttctctttcttcatctctcctctcctggttttgcctttcattgtattctctatcacacaatagcattgtctgttctttagcacaaatgcagtcacttaatgtttctcactttatcttcaaagtgaaatataaactaagcccacactcacatccctctcccttctctcacaaaccatttctcagtatctagacaataagccacaacttagatttcaagatttcaatgtatttttatgtggtgtgtttttaatgtgataataatgacaattattctgaaaattttctttttgaagttcttaaatttgtttctcataaaatatgttcctaagtttgtgtacgtcccatttccaagtcacattttacattgcgcattctagtttattttatagtataggctacttttgttttacaaaaatcataagttgcttcctcccagctattcctcagtaaataactattctcctcatgtgggactatccaaactcagcccaacagaggtctttctggacaccacttagaggcacaggccagcatcctgctgtgatgattacagatgttctcatttttgatgaaagaagagagaagtaacaacccacagttagcagtaagtcccagtatacctgcttatctagctgagtgttctagaaatcacaggccgaaaatctgtatctccctggatatgcatttggccaatttagctaaagaaaagttataatttagagtcatattttcatctatgtaagtatgagataaaagctgtatttttttgtcctaattaactttaatgtgtttctttcttggttattccagatgtacttaagctgctgcattggtttatattcttctcttatttacagatttgtggaatctagatagaaatctttctaaagtacttcaaagcccaaatttattcaaaatccacttttcagaatattcacaaaaacattaaaaatatattcaaaaagagagaagcaattgaagattgcaatgaaacctagtttataattatttatttaaaggtcatttttatctcatttccccagtggctaacagaaaaacagagcccttcaaataccaacgataattacagagaaggacaaatgcaataatgttcttgatattgggtactgtagggaaaatgtttgccctcggagacacattttcttccatatataaattcataaacaaatgttacatttaatttgaattcattttagtagtaatttttagtagcctctcagctatatttaacagtttaacaatctatgtcccctgattcagtccaatcatgacaattattaatcgtttttatttaacaatcttaaaactcctgagatattgagtatattatatcagctcatttaatacatatttgagattcattagacttttcataacctcaaaaatagacaacctgtattcttaaagtaattgtaagtagaatccctatacttttctatggcaagcaaaccaattaacaccaaaataagtacttgcttggcagaggccaaaaaatacctgaataaattgaaaacaatatgggttgaaaaagctaaaatttttctaaactcataaaagatcaaagaaaagtaattaccataaatctgtatatctaaaagcacatcatttactttgaatagaatcttggaaacctggagttccaagaaaacttacagaaaacatttttaaccttttgaagagtcaagactcttttgagcatgtaatgaatgcttatgaaccctctctttagaaaaatctatgcatgaaatacacaaaaaattgcttaactctaggtagtttgtagaaaacctgaagatctcttagagattgtatatgccaagttaaaaatccctatcttagatatagccagatcttatattctacaaaatctatttcttggcttcataacatatataaatgataatctgttctttattaaatacctctggttccagaaaaattactaattttaaaaatattcgattttttgatacttgtaattttttttttaagttctgctttttattttactatttaactgaaatcagaagttctgaagtctctagctacccagagtaaatccctttcacatgatagccttaatactcaaagtatagctatagtagccttctttggtttcttcttcttcaagccaaatgtccctaaaaccttcagtcaatcttcataaagcctgatgttcagattcctcaaaattttgagcactctcctatgaatgttctctaaaagtgtccttaaaacgtggcaaccaaagtaagtgcacatgctatttgatcaaataagagtttattttttctactctacagagttaaaacacaggagtggaaaattgggtaccttattatctcaaacttcacttaataaggttaaaattaggaataaccaaatataagtaaggttagaatctcaactatgtgattaacagaactttgaggcagaataagataatggtgctaacttcccacacactcttttaatattttatccatgaaatctcaggaaggcatgacacaactatcactgaaactaataaaaatgaaaaaaaaaataaatacacggtattccaagtgagcaaaacttgtattaactgaaggtagtattcaggatgtcattttaaaaagaaagtgaagaatttgctagtgttctggacattgaatctgggatgcagaaatggcctggatgagatgtctcttgaggctacccttctgcttttctaattgagtgcttaccaagagacttgtgattatttatttgatttctcaaatgccctattagtggaaaggagatactaaggatagaaaatataagcattccgatcactaaaacataaacctcatcttcttatcaccaccattgtgatttaatgcagtcaaaatgatgattcatacttagtttgagaccatataagttgaataactttactgcttttattaggtcatatgtttttcatattatactttccatttgaatcttggatgtaaggacagaaaaataccataaatttctgtctgaagttcttctaaaacagataacaccagtcaagataatttgctataaggtcagtagtacatctgctaatattagtagtacgcacacagaattgatagcgtaatggatgaaattgagatcccttctattatctaaaattattatgaactcactcagctttcattatttaaaaagttaaatcttatcctcattaacaccattgaaaagtatattgaacaagacaatactgaacaccactaatagagatagtgatataatctgataggctgcttttatggaccactggcctctatatttgtttcctgaggctactatgacaaattaccacatatttggtggtgacttagaataacacgaatttattctatcacagttttggtagctggaagtctgaaatatggcaaggttgcatgccttctgggagaatccattccttgcctcctccaacttctggtggctaccccagaattcttgagtttgtggctgtataactttaatctctgcctccatcttcatatcttctattcctttgtgtgtccaactcctcctatcctgtcttataagcacacttgtcactggatgtctgtcctatccagataatccaggatgatttcttcatcttaagatccttaacttaattacatttgcaaagaccctttctcaaacaaggtaatattcacgggttctagaattaggaaatagacatatccctttgtgggtcatcattcagaccattatagcctcctagtcacgttttgccttatcacttattgtattttcatcatagaacttggaactggaacattttaggatacagtgactctatattttagtaaaaagtgtgtaattaatgccatagaatgtaatcaacctcattagtaattcctcctccctgttgaacaacttgaagcgttgcaggactgaagactttcatttcctgtgtaattatcccacacctttggttatgacatcgttctgctagaaaataatatgttagagctattattctaagacttcaatccctgagttggatcaatatgttctgagatctgctttgaacggtagtaggctcagaagcttgatttaatgaatatatccagaggttatttaatttagagcaactgattcagatccaaaaagaccaaattcataagatacatttatatagaggttaatataatactcttatccaattttgtaagaggacataataataataagagataccaaaatagctagttcacttagttggtacatgatattcctgtaggaaatttagataaaaactcatattaagaacataatatagccttaaatatgaagtatctgagcaagtatagtgacttttttagttttaaatggtagatttgaacatttaaatctgtgcctgagttcttgactgaagctgtgtaagtctcagggtgacctgaaattgtagtttgttattcaggatagtctttccatgtggaagtttagaagacaaattattttatctttgagtgtttttattctgtattccatgaacaacaaacatttcataaggaaatttggggaagacaattgtctaagtgcctattatagctatactaatcatattaatttcagttttaatcaaatcatcttgattaaaatttggatgatcctgattctagtgactttgtaatatgtcaacttggataggctgaactaaatttccaagaattccattttctgtatgtttatggtaaggattaaccccaagacagagtcttctgaaagatttgaagggcagaagtttatcagcacccattttgtagctcacaatgtttcctttgattgactgacttatcttgcttgcgtgaagcagtaactgagcctacactggctccacttccccgtagatcttccttcaacttctccagctcccggaccacgtgtgtatttttacctccatgacaaagaattgcagcttcagcaggacattcacatcacaaagtcagaggaaacaagaactaacatagttcttggtttgttttcatcatccctacttcatgcttgtgggctacaatttattcttgttctctacactttgaacccatattctttccatgatagccttccctgtgcacttccaggtctaccagcatcagatgcaaagtaaacagcctttcagatactgcttaacaaactcccacaattgcataagtagacctcagagggccgagctgagagctatggacaattatttccagaaatttagatctaatccagaaactttgccaggtagatttcagaattgctatggaacaatgattttttttgtggctcccattttccttttctttaatcaagagtgcctatagcacttattgcatgcttgtctcactgttatatgttgggtgggtaatggataggtggctcatctctttagttttacaggtctacaaattgagagaaactgtacagtaataactatacttatggaactacatgcaaaaaggctaattcatttctgaacctaacatagatgatataattttggactttgagatgatgctgcaatgggataagactttcgtgaaacttaggaggcagtaagtgtactctgcatgtgggagggatatgaataactggaagccagtgagcacctccaagatggccttcagtgatttcctccttctgatatttttgtctttgtgcccttgtacatcacctccctcttgagaatgggctgtgttgagtgtcttgctactagcaaaaagaatgtgatagataatggtggagtatcacatccatgattaggttacaaaaagactatatgctcttctctctctctctctgttcttattttatgaagaagcaagctgtcctgttgttagtaacccctctggttaaacacctgaggcctgccaaaagctatttgagtgagcttagaagcagttactttcgtagtcgtgtgttcacataagaccacagacctggtgagcaccttgactacagtcttatgagagaacttaaggatcatacatccagccaagccattcccagattcctaacacacaggaattatgacataattaatatctgttgttttaaggccatagaataacaaattggggataattttttataaaaaatagatcactaatacattgacacgggcttaattggttaaatgattatttattaaattttaacacttttacaaatggaaaatattaatcattacttgtcacatttattaattccatacttttacgaaaagtgagaaatcctattctcaggtactgaggtatcatattagacttatgtaccaacaacatatttcaattgcttattaatgtatctagttttactatcctctaactaatagaccttcattttaaaatattgtattaaaactaaatttggaaccccaattttaaatattcagtccatatctcttgttatcaatgatatttaaaaataaaccatgtcggctgggcacgatggcttacacctgaaatcccagcactgtgagaagactaggcaggcggatcacttgaggtcaggagttcgagaccagcctggccaacacagtgaaacccaaaaattaatcaggcgtggtggcctaggactgtagtcccagttactagtgaggctgaggaacgagaatctattgaacttgggaggtggaggttgcagtgagctgaggttgtgccactgcacttcagcctgggtgatagagtgagactccgtctgaaaaaaataaataaacaatgtgttcactctgtttgattggttttccaaaaaaattattaattttatttacatttttaaatttaattttaaattaaattttaaattaaattttaattttaattttaattttctggaaacataggtgtatgtttatggggtatacaagatcttttgatacacacatgcagtgtgaaagaatcacatcatggaaaatggatatctgtcccctcaagaatttatctttctgatacaaatatttcaattacactcttttagttatttgtaaaagtacaatctattattgactataggcaccttgttgtggtattatatagtagattttattcattttttctaactataatacctttttgtacacattagacaccccacattccccccaggcccctactacccttcccaccctgcggtaaccatccttctactctctatgtccatgagttaaattgtttggatttttagattccaaatataagtgagaacatgcagtgttagtctttctgtgcctggcttatttcacttaatatgctgaactccagttccatcaacgttggtgcaaataacaggatctcattcatttctatggctgaatagtactccattgtggaaattttactacattttctttatccagtcatctattgcgggacactgaagtttcttccaaatattagctattgcacgcagtgctgcaacaaacatagcagtgcagatacctcttcaatatactgatttcctttctttgggatataacccagcagtgggatttctggattatatggtagcaatagttttagatttttgaggaacctccacattgttctccatagtgggtgttctaatttacactcccgccaacagtgtacacaggttcccttttctccacatttgttactagcatttgtttttgtgtgtctttccgatataagccatttttaacagggatgagatgatatttcattatagttttgatttgcatttctatgatgatcagtaatgttgactaccactgcatatgcctgtttgccacttgaatgtcttcttttgaaaaatatctactcatatattttgcccattttttattggattattggattttttacctatagagctgtttgggctccttgtatattctggttattgatcccttgtattatgggtagtttgcaaatattttctgccattctgtgggttgtgtcttcactttgttgattgtatcttttgctgtgcagaagctttttaacttgatgtgatcccatttgttcatgttttctttggttgctggcacttgtggggtatagttcaagacatttttgcccagaccaatgtcctggagaatgtccccaatgttttcttttagtagtttcatagtttgaggtcttagatttaatccattctgatttgatttttgtatatagtgagagaaaggggtccaatttcattcctgtgcatatagattttcagtttcctcagcaccatttattgaagggactgtcttttatccagagtaggttcttggcaacttttttgaaaataagttcactgtaggtgtacgaatttgtctctgggttctctattctgttccattcatctatgtgtctgattttatgccagtaccatgctgttttgataactatagatttgcagtataatttgaagtcaggtaatgtgattcctccagttttcttctttctgcttagaatggctttggctattctgggtcactcgttactccatacaaattttaggattgatttttctatttcagtgaagaatgtcattggtattttgataaggattgcattgaatctgtaaattgctcagtgtagtatggaacttttaacaatattgattcttctcacccatgaacgtggaatatttatccattttttagagtcctcttcaatttccttcatcagtttcttacagttttcattatggagagctttcacttttttggttaagttaaatcctaggtatttaattttatgtgtggctattgtaaataggaatacttttacattttatttttttacatagtttactgttggtatatagaaatgctactgatttttgtatgttgattttgtattctgcaactttactgaatttgtttattagttctaatagtttgcctgtggaaactttaaaatataaaatataaaatcacatcatcagcatacaagggtaatttgacttatttctttccaatttagatgctctttatatctttctcttatctgattgctctagttaggactcccagtactatgttgaataacagtggtgacagtgggtatccttgtcatgttccagatcttagaggaaggactaggtttttcaccacttagtatgatacgagttgtgggtctgttgcatatggcttttattatgttgaggtatgttccttctgtccccacagcgttgagggtttttatcatgaagcgatgttaaattttatcaaatgctttttcagcatcaattgaaacaacaatcatatggtttttatccttcattctgttgatatgataagtcatgttgattgatttgtatgttttgacccgtgcttgcatcccagggataaataccacttggtaatgataatgtactgttgagttcagtttgctagtattttcttgaggatttttatgtgaatattcatgaaagatattggcctatagttttcttttgttgatgtgtcattatctggcttggaatcaggttaatacctcatagaatgagtctggaagtatttcttcctcctttatttttggaattgtttgagtagcactggtattagttgtcctttaaatgtttagtaaaattcaacagtaaagccactaggaccagggctttcctttactaggattatttttattatgactttaaactgattacttgtttttttttctgttcaggttttggatttctccctcattaaatattgtaagtttgtatgtatattagatccatctcatgctgctacaaagaactgtccaagactgggtgatttataaagaaaagagtattaattgactcacagtttcacatggctggggaggcttcaaggaacttacaatcatggcagaaagggaagcaaatacctccttctaaacgtggcggcaggacagagaaatgccaagcaaagggggaaaacctccttataaaaccatcagatcttgtaagaactcacttggtgtcatgagaacagcataggggtaactgcccctatgatgcaattacctctcactgagtccctcccatgacacatggggattatgggagctacagttcaagatgagatttgggtggggacacagagccaaaccatattatcaagcagctggcccctccaagatttcaccttgtcaaatttcaaaacacaattatgccttctgaactgttccacaaagtcttaactcttcagcattaacccaaaagttcatagtctcatctgagacaaggcaagtcccttctgcctatgagcctgtaaaatcaaaagcaaattagttacttcctagatacagttagggtacaggcattgggtaaatgctcctgttccaaaaggaaaaaattggccaaaacagaggggctacagatcccatgcaaattcagaatccaaagaagtagtaattaaattttaaagctcccacataatctcctttaactccatgtctcttatccaggtcacgctgatgcaagagatgagcttccagggccatgggcagctctgcccctgtggctttgcaggatacaatccccctcctggctgcttttacaggctggcattgagtgtctgtggctttccctggcatacagtgtaaactgttggaggatctaccattctggggtctggtggatggtggccctcttctcacagctccactaggcagtgcccaagtggggactttgtgtgggggctctgaacccacatttccattccacactgccctagcagagattctccattaggactccacccctgcagcaaactttggtctggacatccaggcatttccatacatcctctgaaatctaggcagaggtttccaaacctcaattattgacttctgtgtacccacaggctcaacacgatgtgaaagccaccaaggcttgaggcttacaccctctgaagccacggcccaagttgtaacttggcctcttttagccacggttggagtggctagtacacagggcaccaagtccctgggttgaacacagcaggggtccctgggtgtggcccacaaaaccatttttttctgttaggcctcgaggcctgtgatgagaggggctgccgtgtaggtctttgacatgccctggagacatttccccattgtcttggtgattaacattcggctccttgctacttatgcaaatttctgcagccagcttgaatttctccccagaaaatgtttttcttttttttctattgcatagtcaggctgaaatttttccaaacttttatgctctgcttcctcttgaacactttgctgcttagaaatttcttctgccagatatcctaaatcatttctctcaagttcaaagttccatggatctctaaggcaggggcaaaatgctgccagtctctttgcacagcaagagtgacctttactccagttctgaacaagtttcttatctccatctgagaccacttcagcctggatttaattgtccatatcattatcagcattttggtgaaagctattcaacaagtctataggaagtcccaaattttcccacatcttcctttcttctgagccctccaagtctctaggatgttcgaaactttcccacatttttcctgtcttcttctgagccctataaactatacatacttctgcctgttatccagttctaaagacacttccacgttttcaggtatgtttacagcagcaccccactctctgtggtaccaattttctgtattagtccattctcattctgctataaagaactgtccaatttttataggaaatttttaatttttaattgatttttacaggaaagagttttaattgactcacagttccacatggctggggaggcctcaggaaacttacagtcgtggcagaaggggaagcaaatatgtgcttctaaacatggcagtagaaaagagaattgcccagaaaaaagaggaaaagctccttataaaagcataagatctcatgagaactcacttactatcacgagaacagcatgggagtacctgccccaatgattcagttacctctcaccagtttcctcccatgacacatggggattatgggaactacaattcaagatgagatttgggtggggacacatagccagaccatagcagtatctgtttaggaatttgtccattttttatcattttttctaatttattatcatacagttgctgacagtagctattaatgatcctttgaatttctgcaatatcattctaatgtttctttttgcatttctgattttttaaattttgattttctctgttttcttagtctggctaaaggtaactttaaagagaattaactttgtgtttcttttgtattgtctttttcatttcagctttatttatttctggtctgatctttatcatttattttattctactaattttggatttggtttcctcttgctttcgtagtttgttaagatgcattttagattttttttaagtttttcctcttttttgatgcaggcactaatagctctaaacttccctcttagtacaggttttgctctatgccataggttttgttatgttgtgtttccattatttttttcaaaaaaaaagtttatattttcttcttgatttcttcgttgattcactggtcattcaggaacatattgtttaattttcatgtatttgcagagtttccaaaattcctcttgctattcacttatttttgttctcttgtggtcaggtaaggtgcttgatatcatttcaattttttgaatgtttttagacttgttttgtgacctaatatatgatctatccttgaggataatccgtatgctgagataaacaatgtgtattctgcagccattggatgaaacgttctgtaaatatctatcagattcacttggtctatagtgcagattaagtctgatgtctctttgatgatattctgtctggatctgtgtaatgctaaaagtggggtattaaagtctccagctattattgtattggggcctatctctctctttaactctaataatacttgctttatatatctggatgctccagtgttgggtgcatatatattttaaattgttatatccccttggtgaagtgactcctttatctttatatagtgaacttctttgtctcctcttatagtttttgtcttgaaatctattttgtctgacataaggatacctactcctgttctcttttagtttctattggcatggattatcttttttacatccctttattttcagtttatgggtatctttacagatgaagtgtgtctctggtgagccgcagatcaatgagtctcttttaaaacttcattcagccactctgtcttttgattgaggagtttagtccatttacagtcaatgttattattgttaagtaaggacttttgctattttgttatttgttttctggttgttttgtggtcttctttctttacttcctgccttcgtttagtgaaggtgattacctctcatgatagcatttagtttctcactttttattttttagtttttggtttgaggttaccatgaggcttgcaaatactatcttactaccattatttttaacctaataacaacataacactctttgcataaacaaacaagaaaaaaaaactgataaaaactaagtcttaaattcatcctccaggtgctttaactttttattctatttattccttcttgtattgcctatgtcttgaaaagttgttgttgttattatttcttattgtttcattatttactcgttctacttagaataagagtagtttacacaccatagttacagagttatactatttttacctgtgtactattaccagtgagtttcataccttctagttatgacttattgctcattaacatcattttctttctcattgtagtactccctttagcatttcttataggacaggtctggtgttgatgaaatctcccagcttttgtttgtctggaaaagtctttatttttccttcatgtttgaaggatatttttcgctggatataccattgtaggtgaaagatttttttccttcagtactttaaataggctatgccactctctcatggctataagggttccactgaaaagtctgctggcagatgtattgaagatttattgtatgatatttgttctttttctcttgctgcttttaggatcctttctttaccctggacctttggaagattgacgattaaatgccctgaggtagtcttttctaggttaaacctgcttggtgttctattaccttctcgtacttggatattgatatctttagatttgggaagttctctgttattatccctttgaataaactttctgcccctatctttttctttacttctttaagtccagtaactcttagatttggctttcgaggctatcttctaggtcctgtaggtgtgctttatagatttttattctttttacttttgtctctgtttactgtgtattttgaagtatcttgtattcaagctcactgattctttcttctgattcatcaattctgatagtaaaggactctgatgcattcttcagtatgccaattgcattttcagctccagaatttcagcttgattctttgtaactatttcaatctctttgttaaatgtatatgatagaattttgcattctttatctgtgttatcttgaatgtcttggagtgtcctcaacacagctatttttgaattctttttctgaaaggtcacagatccctatttctccaggattggtccttggtaccttatttagttcatttggtaacgttaacttttcctggatggtgttgatgctagtagattttcttcggtgtctggacattgaagagttagttatttattacagtcttccctgtctgtgcttgttggtatccatccttcttagaggggctttccctatgtttgaaaggacttacttgttattatctgtgctgtaactgctttaggggacactttcatttcagtaatgctgtggttctagttgacttgtggaggtatcaccctgatggtcttggatatgatccaggagaattttctggattaccaggcacagtcttgttttcttccagtacttttgattgttcttattaaatgtgtcttacaccctacatatgacttcctacagttttaaatattaataatatgtttaataatctaccacatatgtttatattttaggttaatgtcaagcttattaagctgtactttagtgcattaaaaaatatgggtagcttttagacatatctacacaatcaccttgattgttttggaagtcagaatcctcttactagtatcttctgttttctgtgatagagaagaaggaagcacataagaactgtgggctttaactttccttttttcttatctcagttttctagtaacattaaaccctctctctctccaaatcctgctttacttctattttctaaacacaattgaaataaccctatctgtgatcataatatcttaccacaaaccttcacttatttcatgttttatgatttctggttttttgttgttgttgttgttgttagttagttggtgaggtggataatttgttgtttgtttctacactaatcctaaaatgtttcatactatgttttttgttttcacaaaaatcaagtttttttagttaagttatagacagctaatatatctaccttttatttcattatacttttaagcaaaaaatattacatgaatgtcctaacttatatttctctctattctggttcataaatatacaagcatttattattgacacatagcaaaacataaaaataaacacacaacaaagtattattgactaaataacctccagaaacattttctgcattcttattttttttcttggactcttccacattcatgtaggagttgggttgcttaaagcagcctactaatctttatgaaccgaaactatactcaagtccatattttttctcctttcttattcccaatgtgttttccctcatgtttattgtctctttatggagcttatatctcctctctgcattcatacttctattacttaatgtacttatctccacaatccctgtctccccctccctccctccctcaccccagaacccccctaactaaaccatttcactctctttaacaatacttttacaagcaaactatatatctaacctaaattcttacagctgtaggttcaggccattctcctgttttactatcactttggcaaaacaacaacaacaaaaaaactgtacagtattcttcataaattatttatgcaatgcttacttcttggctattttacgtattctgtcatattttcccttaattattccttacaggatctatttcctaccctgaactttgccaaaattgatagtaaccaacttgacaaacataatcagggtgcttttatgatccctgacaatagtcgttaaaaattgccaggttatgacattaaaataaatgcttagagtcatatgttaacatgataattagatcaataacttggtctaaaatgaaaagtcttctccagatatgccaaaggtaacttgaaatggaaactaacagaatgacctaaataaacatattactgctaactattagctgctccctttgaagggtctgtttgtaggtgtcctgatgaaatgctatcttgatcttatttaatattttcgttaacaatctggaaaataatagtatcatttaattaaactttgaagtgaatggaaattaagaaaatgtgcaaacaactgctgaagagagaaataatataaataaactaataggggttaacaaactggcaggaaatgaaatgattgcaaataaaaaataagtgctagctcatttacaataaaattaggtgacatttaaagagttaatattttcgttaaacttcaaggaggcaaaattctgtggtaagtactagaataaaggagacaaagtacatgttctgtattgaaggacatcacaatctagtgaccagcaagctatatggtccttaaaattaaaatttcagtggaatattgtaagatccctagaaatgactcagagctcactatcccacttcagatttatgatatgatatgatatgatatgatatgatatgatatgatatataaaccaagacctacatttttcactaaagactgaccacaataattgtgccatttcagcattaagccatgcttgctctattatgatcatgagttggaatacatatcataaagggtaaatattaacagatactccctgactcaatgacttacaattttaatatgtcaagaaagtgtaaatgctacaaatctggcaataaacaatcagtgcatctgttatccacattgcataggtagataaaatatctttggatgattttcctggcatatttttaatgaaaaattaaagagaagatcttttttgaacctcaaagaaaattcaagtcatattttcatttcagaattggtaagcaaatgttaaaacttagtttagatgactcaattttttaaatgtgttacttttagctcctgcccccaacgtggagtgggaggctttcatgtgtgttcttaaaaaaatttaaattaattttaaactgtatttaagcaatttaaactataattacaagcacatcattaaaagcttttgttttctaatttcaacagcctggagaccaccaatatttatctttatcactaaggaaacttttgttattttcaaatatataaccctctggtttctctacaccagtgcttttctataggtagctgctagccacattcacttttgcaatttaaaataaagttaaacataattaaaaatgttcttcttcagttgcactggcctcatttcaagtgctatagtcacatatatttatggctactatactggaaagcacagatatagaatatttccatcattatcacataaagttctattggacaacagtgctctataataagattaaacttcttaaaaatatgtccgttgacaaggaaaatggcatccaccatttccttttcttaggtttaggccttgataaatctccatcttgaaacttgtagagataaaaacaaaactacttatttgtgtaatttgagactttcttgattatgtataagtagaaaaaatacaaaaataaatttgatgaggaggccaatatcatactaaaatattaactaaagaggtctatttaaaatatctatctttatgagaacagccttcttgctgtcatttttggctttatatcaagtaaatattattcattaagtgataaagtaaataaacatttaacatttcaaagttaattgattttgaatactaaaacctgttcctcgcacaatctttgtcattctcagaggaagactgtgggagaaactggtgtatttctaatctactcgttgctcaagtcagaatattagatgttttcttaactattctctttccccgtaactcctgtcacatccatcagcaaactgttgattttactttcaaaattaaaaaaaaaaatccaaccagttattgacaccatcatcaatgctaccatattagctgaaggtatctatccgtcttatatcatcttatcccttttggataaaactgttactccttttctaaccttgacttttcacaatctactcccctcttcactgatattttaaaacatactctgatcataccactgttctacacaaaatttttcagtgtcttcttgtctcagagcaaaatctagcattcttactatcgtacataaagctctatattatctgcatccccaacttccccaacctctgtgcttcatctaacattttttttccttattcattcaccaggatccagccacagagttttcctttctgatccttcaattcactctgcatattgttgcctcagggcctttgcaattgtccccactcccagtaatgatcttccttcagatatttctgtgactgaccatagagacttttaggtcagtgctgaaatgtagccttatcacaaatgggtttcctcaatattctatgtagaatgataaatcatatccttatttctgttaacctgattcatgcttttttgtatcacttgtcatattataaatacgctccttcagtttttaaatatctagtcatctcacaataaagttcaatgagggtatagaaaattgtagacctttttttgttcattgttgtttccctagtgactagaacctcatttgttaggtttccaaaatatttgataagtagttcaacattaaaatatgtgacagctgcagggagtggttaactgagagcctccgggtgcaacctttggaattcactgcaatatttacattagtggcaagttcctggtcagtgactaggagcagcaatgactgctcctagtcagtgattgagcatagcaaggttaatgaagcatgaccaatatatgacctcattaatggacaacatgaagctatgaaatatagtctagggcttttcttacctatcttcatctccctctcccttcattggtgtcagacatgcttcatggtctatgtctctccctttctatcctggttccttgcagattattctttcataggcatttacctcaatacatttcttgtacttctgtatctatctaggtgtctgcttctgggaggacctgaactgacagagattaccattttgagtttactatttattttttaggtattataattatgcataataatttgttttgaaaaagaactctgtagctatataaaggagaattttttttttttgacggaatctcactctgttgcccaagctggagtgcagtggcgagatctcggctcactgcaagctccgcctcccgggttcatgccattctcctgcctcagcctcctgagtagctgggactacaggcgcccgccaccacgcctggctaattttttgtatttttagtagagacggggtttcaccatgttagccaggatggtctcgatctcctgaccttgtgatccgcccgcctcggcctcccgaagtgctgggattacaggcgtgagccactgtgcccggccctaaaagagaaaatttaaattgtatagtgtgtgtgtgtgtgtgtgtgtgtgtgtgtgtgtgtgtgtgtgttcgtgttctctctccactagggactcaagcttctcttagcatagtggttgccaggattagtggctgaagagagaaagatccaggtactaagttcaagtaagcattgagagtcaaaacaagaagagctgaattagtcatccgcctatgtggctgcaaacaagcaagtagcagaaataaaactaagaattttgaattgagtgaaattgagaaatagaaatggaggcacaaggcaagactgggataaagtgagatgccttgatcattttttacaaaataaatcatgagacctaatgctgattttgttttgagttctagaggatgctgtgggtgagtgcttactgcacattcacattacaacatacttctttcaacatggaagtagatgataaaatttgaaatacgttttttaaattacatagtatttattttaataatctaggtctttattgtttcagtctctgttttggtatgccagagattaagagcaatgttcacaaaatggaatactgagattctcaacgattattgagaaattttcaaaagagacagagagacttagaagacatggttccaagcagcaatattgatggtactgaatgaagtacttaactgcagagaaccacgttcataaaattttcagttccttttttggacattttcctcatttaagattttattctgagtacgctaactctgttaattgaattatagtattaattcatgcagataacagcaagttgattcacagattagtttgagacctacaatgcagtagtactaagggcaatgccatcttaaaatgaaaggagtatctaggttggaatgccaagataatcaacctatagtataagcaaaatgggaagaatttactttttcagggtgaagaggacgtgaaagttttttgagcctaataactacttttaaactgattaattaatttgaaacaattctgggtgcatactttgagttgggtactgatgatctagggatgttgaacaaaacagataggaccttgcccttgttgatatttggtatgcatttcaaaatggttctaggaagggtagtggggagggagcaataaaagggttggttaatgggcacgaaaatatagatagcaagtagtacaatggggtgactacagttagcaatttattatgtattttaaaatactagaagagtagatttagaatgttcccaagacaaagaaatgataaatgtttgaggtgatgggtgccaaaattacccagatttgattattacaccttttatgcttgaatcaaaatatcacataccttacataaatatatatagctattatgtatctataagatgtaaaaataaaaaagtttattcatttattcatgattttggtaatgaaccaattgaattgggagtataattcaagactttctggtttttttttcaaatacatttatttgtagaggaaaacattctatataaacaccagttagaaatattgtagaagataaaaaacacattctattaatctggagtattaaaacaaggaggcatcctacaagcaaaatgttatcagtgagatatattttgcagaatcagcctaaactccttcagagaagtggagcaaagaggttagtgttaaacatgttagaagcatcctatggtgcagacattcacattttcttggtgtgacagattaaaaagaagtttaatccaatggcatttaaaactgtcattggccaaaaatagttgactggaaggtaggaaacaagaaggataaaattcagtacaaaagagatgtgacattaacactgtttatatatcatcacttcagttcacagtcttaagtgtctgatagagcagcaaaacattcaaggtatttaaatatctgaccactaagatctgaaagatatgtatttccttcaatgcgatagactggataagggtaacatggagaatagaatcagttatttgctgagttataccttaaaggtcttgctatgaagaacggagtgttaatgatgctcaaaaggaagttttggtgcaaattacagacatcagtgcacacataatgtagaaagttgagatgaacaggacaaacagaaaatgtggcagtgacaagagattatctagcttcatttgacggagttatcaattcagcatttgtaaaaacccaagaaggcaaaaaaaaaaaaaaaagtcacattataaattgtatcattaaatgggatgatctagtcacatggttgttaggagacctgtgttctacaggaagtgaacactgattaatgacttgattcattttggaaggcttttgtctagtaagaatattaaaagattttagataaatttaacttcccctttcttaagatatactctcaggtaagatgattagtttttttagaaatggctgaatgtcaagtcatgaagaaatctgatgagacatgtaaatccatgcttagttgtgtggttataaatttggagccttctaatgagcatccctattaagcctttacggttctcttatttggcaatgtaagctcttttaatattagtatattagttacacatatctctcagggctgcaaattactcatctttaagaaaactttctataaagttttccctttaggagacggaactgtttaatgttttcaccattaatgcagcatgcaaacttactcaggtagtcaacaaaatattgggaaaaatatcaattgtatatgatatgtatttgttttttaaaactgcatttagaaatataaatattatattacattagatcaatgaaattatgcaataaagaacatatttttgtggggaagcatatttgtttttctcttctattaattgaacatcatcagttcgtcctttttttaaaaaaaataaaaccacatattgtcattgaattgggttactgatatcactttgggatgaattgacatcttgcaaatataagttttcccatctttaaaaaggatatatcacttcatataatgaaatcttctttaatatttttagcaatgcttttgtattggaaacagtaagtaagcagtatagcagtccatttggagctatcactctgatataaaaaaatacaatttatttttatatattgacctagtaaactatgactaagctaagttcacttagttatagtcattgctttgtagattgctaaggatattgtatgtagataattatattattaatagattcagttttacatcttcttattcaacctttagatatttatttattttcattagtgtgctggcttgaacctccagaagagtgttcaatagaagtgtttacactgaacactctttctcttttttaccttagggaaaactttttcaatatttcatcattcactataattttagataatatttagatgcctcctatcagagttagagtgttctattcctagttttcttcaagtttttattataaacgggtctgaattttccagtgctttttactgtatctcttcaatgatcaaatgttttctgctttattttgctaatatggagatatatattcttgatttttaaatgttaaacacaccttgccttcctgtgataaatatcagttcatcataaggcatataatattatatttaatttccttattttaagagtttttattttaggttcatgaacaatactgatgtacagtttttattgtaatagcatttttgtcaggttttgttacaaggtattcctgaccaaataaagcaagtgagtaagtctccttgcagtctcaatattttaaatagttttcaaataatggtattagtttctttttaagtgattcatagaatcctgcacttaaaccatttgcagtagatttctttggtttttaacaagatattcaatttctttaataaatataggattatccatattttctcaataattatgtaacctttgataaattttggtttttacaaatgtgtctttttttatctgagttaccaaatttcttgtcatgattgtttttttaaatgattctcttaaaaatgtaaaaaaaatcccattaattatcttttaatgtctgtaggatatgtagtgataacctttctttattttccaattataacatctttcttttgattattcttgctagcaatttaacaaattggttatatatttagagaaccaacttctggttttgttaaattttctctatttttgcatgtgttctatatcattttttctacttttaaattgtttcctcttttctctggttttaggcttgttttcccatttctagtttcttaaatgaaaattaactcactagttttaataatctctttgttttcaatatgagtttttaatgctacaaatttccctgtaatctctgctttagttgtatcacatacaaaaggaggtatgttgtattttattatcactcagcttgaaatattttatttctattatgatttttttttgacacatggtaattttaaagtgtcttgattgatttctaaattttgaccttttatatttatctttttcttattagtttgaattacattaccttttggctatgaatcataatctataacatttaaatatttttaaatttgtagaacatgccatgtgaaccttgaaagaatgtgtaatctaaaattattgagcattattgagcagaatggcattatggtcaagttggtttatagtatatgcctcttctatattctcactatttttttgtcaatcactgaacaagtcatataaaactctaaattttataatggatttgtctgcctctctttttgactccattacttttttcttcatgtatctttctgagtgctgccataataaagcaccacaaactgggtggcttaaaacagaatgttattgtctcatagttctggatgccagaagtcaaaaatcaaagtatcagcagtattgcttctttgtgatagatctaaggaaaacattgttccagacttctctcctagcatttggtgatggccagcaatcattggtactccctagtttgtagacacatctctcaaatctctgcctccatcttcacatggtgttcctcgtttgtctctgtatcttcacatggctgtattcttataaagacaccagtcacactggattaagggactatcctactccaatatgacctaatattaactaattatatatgcaatgaccccatttccaaataaggtcacattctgaagtacttgagattaagacttcaacaaatcttttgggaaggaggcaattcaaaccattacaatacattttgaagctctgttattaagcatattcacatttgtcatttttatgtttttctgatgaaatgactctttgatctaacattgtttcttctgttactcctcttcttaatatatttttatttatatttattgtttgctattgagtttctatcccaacaacttttgttcttccattcccactcaactgccttccttatgattatttttatgttttcctaatccctttgggattcatttattggccttttagcaatattccctttgtactcttactttattgtagtttgctatagactgaaatattcaaacttgtgttacatagtttctcagagttaatagtctaccacataacataaaatttaagaaccattatgccccatctagtatatatgctattacagtatatattatatccatatatatatacacatatatatatattataaacccctcaatattgtgttttcccctgcaaataattataatcgtcctttggtatcaatggaggattgttttcaggacctcttgtggatacaaaactgcctagaatctcaagtctctaatattaatattaaagtggcatagtatttacatataacatagtatttacatataacatttttgtatgctataaatctctagattagttacagtaataactattacaatgtaagtactatgcagataattgttatacagtgtttaggaaataatgacaagaaaaaaggctgtacatgttcaatataaatgcaatttctttctgaaatattttgcagctgaagttggcagaatctacagatgtggaaaccatgaatacggagggctgactgtgtacatttttaaattaacttaagaaaataaaaaatctaaatacttttgtatatttatgtgtatatcatttgtagtgctctttatttgtcctgtatattccacttgtacctagtatcatttccttatagtctaaaggactttttgttgaaattgttatattacagttctgctggcaacaattcatttagctttcatttatctgaaaatatatatttcgaaggatattatcatggggtataggaaaaaaagactttcagcactttaaatatgcagtgcctttgatatatggcctctgttgtttctgatgataagtcaaatattctataactctgtgttcatttgaatgcagtgtgtttgcttttcatggctaccataaggattttgtctttttttcttgttatcacttggccatgctgtacctaagtctgatcatatttatccctcttgggttttgatgagactctaggatttgtaagtcagtttttcacaaaatttgcaaattatcagccattaattcttcaaatatttctctgtcccattctctttcttttctcctttgagaaatgcaattgtgtttatattaaactgtttgatattttcccaaatatcactaaagcaatgctcatttattttcaatatttatccttcatttacttcagattttattctttttgctgatttatccttaaattcactgatgctttattttgtcctttcctttttcttgttaatcctatgcatagatttttcctcgtgttttagttggcatttaaaattttacatatttatgggatacaaggtggtattttgatatgtgtatgcaatgtgtagggatcaaatcagagtatttaaagtatctgtcacttcaaacatttattatttctttatgttgtgatcattcaaaatcctctcttctagctttttggaaatatacaataaattagttaccttatttgccttaacagtgctgcagaacactagaattcattccttctgtctagctgtaaatttgtatcaattaaccaacctctccctatcctcccttcccctctacctttctcagcctctaataccgacaattcaactatttacttccatgggctcatttttttttttcagttcccccatgtgagtgacatgatgtggtatttatctttctctgattgacttatgttgcttaactaatgtactccaaacttattcaagttatatgcagagattttttttaaatgatgtaattttagctctagaatttccattcttatagtttcaatttctctgttgagattctctgtctattcattcattcgttttccccattttttcttaaaatatctcaacacatttatgataattatattcaagtcctagtctgcttactcaaacagctgagttatttcagaacctgtgtctattaagtgctttcaatccttattacaggtcacgttttcccatttttttccttgtcttgtgggtattacattgtagatactactaattttttcttccactgaagagtgttgatttttacttttaacaggttgttaaatatgttttctttgtggtgggtagtagctcagttctttcgaccttatatttcttgcttgcttctaggcttctgtgcatttttggtgttccccattctgtgttccccttcttttcctgattttccccatcactttctagatgctcttgcagtcctgatgaagcctacttgcttgccttttttcctcatttcttccttgcttgcttgcttctagctttctttttgatctgtagtcactccttgctgtccttgaactggagtgtctcctattagaaaaaaaaatactgtttacaattagattctatccagcgtaaacccccccagtttctgagtttgtgcctgcttttgattattcccttgtacctgtaattagtgcttttgtcggtttcattttgttttgtttatatttgtttgttttacttttgtctggattttatagttatgtatggcaggattgatatgttgcaagttactccacttttggtgggtggtggaccttattcatttttcaagcacatataccttttattatgtgttactttgtttaagtattaactcaaaataatacacaaggttaagtactgttgttttaactcaaaataatatacaaggttaagtactgttattttcttcattttattagtgaggcaaatgaagcatgtaatgtttacctaactttcccaagtccacacagctattaagtggcaggggcaggatttgatcccagcagtgtgggtgctatgatatgccacatttatagccaactgtttgttctaacacaaacatcaatttccaaaattgtttgggtttataaacttacatctaatgtagcatatgggaaaatgacaaatctacataaaacgaatacatagtcctgaaagggtctatgaattgcatttatagttgtccttttccaagtatcgacagcagttccaggataagtggaacacatctgaacagaagaaagtagatttctgatttctaaaataataatttgtttctagcaagccatgctacacaggagaatggttcagtatatggctgagagaagacattacagggaggagaaataagttttacattgtgaaagatgacagagaagagaattaggtgaagcggtgcatactagtcaaagtgatggtaactaagttaaatgagaagacaatgtaagttaggaaatgtgtgttaggaaaaagcattcaggcagatgtgttttttttttgttttttgttttttgttttgagacggagtctcgctctgtcacccaggctggaatgcagtggcgccatctcagctcactgcaagctccacctcccgggttcacgccattctcctgcctcagcctcccgagtagctgggactacaggcgcccgccactacgcctggctaattttttgtatttttagtagagacggggtttcaccgtgttagccaggatggtctcaatctcttgacctcgtgatccacccgcctcagcctcccaaagtgctgggattacaggcgtgagccaccaggcccggccagatgttatttttataagcaaaatttcagaaatataaaataattgtggagactttttgaggtatctggaggaaagttgttatataagtgtgacttattttacttcttgctatgaggcaaaatattacttcaagaaatacctttagcaggaagattttttgaataggatttggaggtcatattagcatttcatatcaaaattgggataaatcagcaagtaaaatccaaaacctcctaataagttttcaaggactttgtaaaagtttgcattaaaaatttgatagttgtggggcaggcacagtggcttacgcttgtaatcctagcacttggggaggctgaggcgggaggattgtttgaggccaagagttcaagaccagcctgacaaacacagcaagatgccatctattttaaaaaagtgaaaataatttgatagttttgaaataaataccaatatcgcccctcctgcataggacagtttacgtaatgtgaaattcgaaatagttttcagctaacaattatgaattcctttttctttttaaaaaatgtatttattattttaattggcaaaataatgtcaatggtgtacgacatgatgttttaatatatgtatgcattgtgaaatggctaaatcaagcttattaacatatgcattatctcatatacttatcatattcttttggtaagaacactgaaattctactgtcttagcaattttaaagtagacaatacattgttattaaatgcagtcaccatgatatatgatagatctcttgaagttatttctcctgtctaactgaaatgtgtccttttaccaacatctccccagtctactactccaaatgagaagattatgattaagcatttttggcacaaatacaacagaagtaatgtcatgctctttccagtatatcatttctggagctatgtgatgtcaatatatactattactggtggtagtaacttcagtctcttagttaagcttgcattggccaaggtttgtttgtttgtttgtttgtctctttctctgtgaagttacaattttcccttttgtcattaatgatttatgaagatactatgagactatgtaaatatcacatttctcatacttttacccatttattttcgttatcatgattcctgcctgtaacaattattattgtggtgtttaaatagttatcgttttctgttgctgtcatgccttttacatttattgtctggaattctactgtaaggaagagctgccctttcccccatctctgtttatttatttacacaattatttatttatgtcaatatggagtcatggatatttattcccagatttggctgttagtggctccaacaagttggcccttgtgtacctttcatcacacctccatcatttttgagccctttgttactttctggcaccacaaaatcaacttggttcgtgttatcttttccccaccccaatcctggtatcaactgcttatccaaggatctctagttcttttacttggaaagtagtatttacaagctaagatctaggtaccacgtttgtcaatttactgctgctgggatgtcattgcttctaaagctttcatcagagagagctaagaaattgtgtgtgtgtgtgtgtgtgtgtgtgtgtgtgtgtgtgtgtatcctcacgcaaatatctctatttctaaacctattgtttcctatacataataatatccatgacttcatactgactcttacaattgcaataaagcaccaagtgttcattctagttttctttctttcttatttgtaactattttctctaatggggagaaacctgactctggtccacagtgtatttctttatttgctcatttataaaataaggataaaatagcttcagagttttaattcacactcctgtgaaagcaaattttctaactagagtatttgtgtacagtttttgttttattttgttttcattttgctttgccttacaggatacatttactgtttttcaaacttatttgtgttaattcttttttctcctttttctttagcgtagttacaattttcattcataatatagtttggtttatttattactgctttttattgtatttttggttcccatattttttattttaattatttcgaaatttaatttttatttacttggggagtatgtgaatctttaacatagtttcaaaatcagagctatatgaaaatgttctatgagaaaattgtcacccccctatacttagtactcagttctctgcccccattcttattgcgttattcccactcacctcttattagtaaccaatcttgttagattctggcttttcctttccaaaatatttttgagtgtatattgtatgtactctctctctctctctctctctctctctctctctctctctctctctctctctatatatatatatatatatatatatatatatatatatccttattcttacatgaatggtagcctactataggtactatacctaccataggtaccttttgcactttgacatttttcactttccaatacatactggaaataagtctatatcagttcatagggatcaccaaaattctgtattcattttataggctcctcacactcatttgtgtatatgtgccatagtttattcagttattttctctgtatgatcattcagtatttttcccaatattttgctattataaaaaatttcaatgagtaaccttctgtgtatgtgttttcatgttcttataggtacatctttaaagtagataccccagttgggctgctggttcaaatgttaagtggatacgtagcctggttaggacttcccataggttcccttacttgtaaaaaaaaaaaaaaaagagataataatacgttcctatcataggtattttgaagattaaaaacatagaatatataaaacatcttacatataggaaatacttagtactgctttagtcccttgactctattcacttacttcttcaacattacacacatacacacggacacattcacacatatatgcagttacgcactgcataacaaagttttggtcagtgatggactacgtatacaatggtattcattcagtaagcaaaatctaatttattattgaagaaagaaattttgtataaatttagtgaagctggcacgtatagtgtttataaagtctacaggagtgtactgtatatcctaggctttcacattcattcaccacttactgactcaataaaaattacatattttattatgtattgcatattacattattacatgaacctattatgtagtgaacaggatagaatgttcaacagatttgactcgggccatgcatgcttcaatgggtggttctgggattctcatgtgtttgctccgtgatgaagaattagatgtttttcttaagagttaagacatgactgaatgaaaaccaagaggtaagatgcagagaaaggtatggatgcctggtaaatagaattaaaatgattgagaaacttaacttaaaacttgcaaataaaaatttaaatgtggctacatggaaaactaattgagatactcttttttagattttgtctattgactttaagaagccacaatcaataaaactccagtttctttttgtacatagtagatccatatctaacatttctaaatcttacaggagtatataaataaatgggggaaataggttttttttttttaatcaatatcatttagctggtcggtattcagttcaatgtatccaacatgaaaaagggattcgttaacatctgacattccattagcgtatgtacaatagaagtagtactgatgttatcaaagagctatgttataattctaagattttattggattctattattttaaaaatattagaaatgacactcattagatactacactagattaaacatgaacattattatcctctttttaataaatacaattataatgctgtaaatgccaaaaggattaactggatgtgtgaataagtcactaccacatattcattcagacaaactttgcatagactttttgcagatactaatattagatatgcttttagatatgaactagatactgaattcataagcattttcattacctagagattaaatcaatcaaaatgccatagaacttttccagttgtacttcatccatgaagaacagaattttgttatcttaaaaagaacaaatgataaagaattatttctggtcctggatcattatcacatacatagtaattttttaataattgtttttccacttgattccactgaaaggagaattcattacattctaaaatttaccagtcatcatctgattggagtatactctctttactaccattagttcattttaacaagcgtaagattgttttcaactgtggcactctttcacatccagctgtattatatctaattgaatcaaactttaaaaatttatttcatttgtttttttgtccgtgacattaggcagtctgtttaaataggttatgcacattacttgtaagtctgtatgtagtagctttttcagcagatatcaatgcattttttcgtccttcattattatgcacagtttttctttactcataaatcataagtttgagtgcttttatttgcagaaaaaaactcttgtttgtatcacaaatttaaaatacaaaataattgtatgtgtgtgttcgtatgagagtgttcatatgtgtcctatgaataaaacaaacattgagtgcctactacgtgtatggcattgtgcttagcgaaatgttagataaaatctatttctttatcattgtgaaaatgtgacataaatagattccaaatatttctgttttaaaatctttttttggctaaaaaatgcaatgcattgaagggatagatatctaatttttcataatagaattcttatgcattgcatgcctgtatcaaaatatctcatgtatcccataaatatatacacctactatgtagccacaaaaaataaaaataaaaaaattaagcaatgcaaaattgaacaaggtagttttcacacccgttacgttacaactggtgttattaaagttacacctcatttattcagaaatcagatcttggcaccttcaaattataaaatggggtgccccaaagcaagaatttagaatataatgaaatgtacaaattcctggaaatataaaacctctcaagattgaatcaggaagaaattgaataattgagcagaccaataatgagttctgaacttgatttagtaataaaaagcctaccaaccagaaaaagcccgggatcagactaattcacagctgaattctatacagaagagatggttccattcctactgaaactattccaaaaaaatgaggggtgaggactcttctctaactcattctatgagctcagaattatcctattaccaaaacctggcagagacacaacagaaaaagagaatttcaggccaatatccttcatgaacatagatggaaatcctcaacaaaatactagcaaaccaaatctagcagcgcatcgaaaagctagtctaccacaatctacttaagcaggctttgttcaacatatgcaaatcagtaaatgttatttaccagataaatagaactaaaaacaaaaaccacatgatcatctcaatagatgcagggaaggcatttgataaaattcaacatcccttcatgttaaaaattaaacatccctttgtgttaaaaattcaacatcccttcatgttaaaaatcctcaacaaactaggcattcaaggaacatactcagccaacgtcatactgaatgggcaaaagctggaagcatttcccttgaaaacgacactgagaaaagaataccctctctcattactcctgtagcactggaagccctagccagaagaataaggcaagagaaaaaaataaaaggcgtccaaaatgaaagagaggaggtcaaactatccctgtttgcagatgatatgattctatacctaaaaaaccccagagtctctgcccaaaagctccttcatctgataaaaaatcttcagcacattttcaggatatgaaatcaatgtacaaaaatcagtagcattcctatacaacaacaacatcgaatctcagagccaaacctacaatgcagtcccattcacaatagccacaaaaataataaatacagttaaccatggaagtgaaggacctctacaatgagaattacaaaacgctgctcagcaaaatcacagatgacacaaacaaacaaacaaaaaatacatttcatgctcatggataggaagaatcaatattattaaaatgaccatagtgaccaaaccaatttatagattcaatgctattcctattaaactaccaatgatattcctcacagaagtagaaaaaaagtgctttaaaattcgtatgaaactgaaaaacagcctgaatagccaacgcaatcttaagaaaaagaacaaaactgggagcatcatattacttaacttcaaactatactacaaggctacagtaaccaaaacagcatggtactggtacaaagatagacacatcaacctatggaacacaatagagagcccagaaatagtgccatacaccaaaaaccatttgatcatcatcaaaataaactgaaacaaacaatggagagaggattccctattcaatgagtggtgctgggaaaactggctaagcatatgcagaagataggaactggaccccttccttgcaccatatacaaaagtcaactcaagatggattgaatacttaagtgtaaaacctaaaactataaaaaccctggaagataacctaggaaataccattctggacatagggcctgacaaagatttcatgatgaagatgccaaaagcaattgagacaaaagcaaaaattgagaaataggacctaatcaaactaaagagcttctgcacagtaaaagaaactatcaatagaataaagagacaacctacagaatgggagaaaacatttccaaactatgcatccaatgaaggtccaatgtccataatctataaggaacttaagcaaatttacaagcgaaaaacaactccattacaaattgggcaaagtacatgaacaaacacttttcaaaagaagaccgacatgccaccaacaagcatatgaaaaaatgctcaacatcattaatcataagagaaatacaaatcagcaccatgatgagatagcatctcacatcaaacagaatagctattattaaaaagttaaaaaataaaggtactggtgaggtggtggagaaaaggggaatgctcatatactgttgatgggaatgcaaattagttcagccattatggaaagcagtttgttgatttctcaaagaacatgaaacagaattactattcaacccagccatcccactattgggtatattcccaaatgatatgggttggatctgtgtccccaccagatttcatatcaaattgtaatccccagtgctgtagatgggaggtgattggatcatggaggtgttcttcatgagtggtttagcaccatccccttggtgctgtcctctggatagtgagtgagttctcatgagatctggttgtttaaaagtgtgtagcactttaccccttgctctatcacttgctcctgcaatgtaagatgccttctcttgccatgtaagactccttcttcccctttgcctttcaccatgattggaagctttttgaggtctcccccgaaacagaatccactatgcttcctgtacagcatgcagaaccgtgagccaattaaacctcttttctttataaattacccagtctcaggtatctctttatagcactgtgagaacagactaatacagaaaattgataataaggagtgtggcattgctataaagatagctgaaaatatggaagcaactttggaactgggtaatggacaggattaccctgtctaaagtggcattcagccacttcagattgagcagtaacaggtctgtgatgctcttagatgtctggggctgcatgcatgccacagtgactggctgtcttcttcccttggtggatgcttgcttcagctcctcttgtcattggacatcagactccaggttcatctgcctttggcctctgaggcttgcaccagcagcttgccaggggctctcaggcctttggctgcagactgaaggctgcactgccagcttccctggttttgaggctttcagacttggactgggccactaccggcttctttcttccccagttgcattcagcctattgtagaactttgtaatcatgtgagataactctccctaataaacttccttttatatatacatatatcctattggttctgtccctctggagaaacttgactaatacaccaaggaaatataaattgttccaccataaagacgcatgcacttgcatgtttattgtagtacaatttgctattgcaaagacatggaatcaacctaaatgcccataaacagactggataaagaaaatgtggtacgtatacaccatggtatattctgcagccgtaaaaaaagaatgagatcacgttctttatagcaacatgaatggagctggaggccgttatcctaagcaaactaacacaggaaaagaaaagcaaatactgcatgttctcacttacaagtgagagctaaacatagagtacataaagacacaaagaagtgtacaacagacactggggcctacttgagggtggagagtagaaggagggcaaggattgaaaaactgcctattgagtactatgcttattactttggtaacaaaataatctgtacaccaaaccactacaacatgcagtttttctatgaaacatactggcacatgtgcacctgaacctaaaataagtatttttttaaaaaagaatataaggatcctaggcatgcagcatatttgcatgatattccaagaggaaattgtttttaccttgaatggcagtataaggtgttggttaaaagctggcttaatatcccggctttcccaaattccaactctaaaaaaaaggagctaaattaattttttattgtgcttaattaaaattaccttttgcaagttttgagttcctcaaccatttcaattctatttaccaaacaccccatcttcctctgcatcctcttggtcaactatggcagcatatttacatataaatacatgtacctatggcacacaacttctgatagctccatctaatgatttttgaaatttacaatggtgtaaaaccgatacacaataggtaggaactgtacttcgagtgcccttacaagcattctgcttttcacttttagtacagtgttcaataaattttataaaatattcaatactttattataagataggctttctgttagatgattttaccaactgtaggctaatgttgtgttctaagcatgtttaggataggctagggtggcctggtgcggtggctcacgcctgtaatcccagcactttgggaggccgaggtgggcggatcacttgaggtcaagagttcgagaccagcctggccaacatggtgaaaccacgtctctactaaaatccaaaaattagctgggcgtggttgcaggtgcctgtaatccaagctactcgggaggctgagacaggagaattgcttgaacccaggaggcggaggttgcagtgagctgagatcgcaccaatgcactccagcctgggccacagagcgagactccctttcaaacaaaaaaagcctatgatgtttgataggttaggtgtattaaatgcatttttaatgtgtattttcaatttatgatgtgtttatctagacataatcccatcataagacagcaaacatctgtaagtcactcagaatagtgtacacacatagggtgtgtgtatatttaactttcaagatgcttgattatcataagcatttcaacatataatcttgcatttcaaaatatgcttctgttatctcatttaattagtgatagtcataactaatttacagaaaacctctctttttcatcattttatagattaggagactgaagctcaaccaattaaataattttcttaagtataattagcaagtaaaagaatgtggtcagtaaaacagaagatgactctaagagcagtttctgttgataacttaaaaaccaagggagtaggggaaaggccaaaacaaaacaacaaaaacctcaaaagccaacagaaaactggctatgactcacctacttacctaagagttgaatagatttgcgtaaggaccatactgctttatattatataaaggggaagcaattatgttaagcaagtactgccacttcctcctccttcatccattaaagtcttggtaaattgcaacattcatcactttacctacatgaggacatgtagtcatttcttacacattactccatgaatctgttttggggtgttagtgttagaagcacagagtctagaaccacagtctctaatatgagtccttattacctctattgcttaacatatctgtgccccactgtcctttgctgtgatatggagataataatagcacccacttcaaaggattgctttgaatctttacgtctttctaattaattgttcttattacccccaagtaaagggatttgacagtaaaatgaatcagattttctctcctaggttaaaatatgttaaataaaataacaacaaaaaggctggcgtgtgtataatacatttaatgttggcaagatggccaatattaatgcacttttttagttaaaatgtaagctttaactatatgaaaacattgctaaattgagatagtggaataaggtatttgttatctttcaaaaatataactaatattattttggggctatattttcttatgggtaactggcacatttttctgtaaaccattattgctaaagtccatagctttgaatttctctttaaatctgcactggtccctgctcccatatttccgtcatgttgttttatctatcagtgcattcctacattttgaatgcattttgaattcctacattctggaaaaaaaatttatataaagaggagaaaaagaacaaattattgttttactttagagtttcatagtcattcacatattttgaggtaaatatttggacaagagaaccacaattgaaaaaacactggggcctatacaaaatacgtaattcttttctaatctgaatattttgaaaaattttgaccttctttatggccaagaacatctatttcatatgatacggtataccagactaattttaatttgtatgtttctgttggtcacaatcatcaagtaattatgtttataattatatatacaagcaatacacttttttttgtttttgttcccgtaagttttccacacttttgcatgctgttccagtactccaaatcttaaaacaaacaactgaaaacaaaaacaaaaaaacaaggatgattaaataaattaactttctatatcagtggtctattctgcattaaaaaaaacttaaaacaataaaaatttaccattacatattagtctgtggttgagctgaaacttctgctgatctgagccaggtatgactgatgtggaatgacttgctcatatgtctgcattgagccagtgagttggccagaggctggttcttacaggatggtctcattcatatgtctgatgactggatggataggtgtaggcaggggcaataagggtgactggtatctcatcattcaacagattagcctgggcattagcctgggcttgatcacttgataatgaatgattccaagagaatgagtggaagcatacaatgtctctggttctagcctcaaaactggcacaacgtaatgcttgctgcactctatttgttaaataagtcgcaagaacaccacagatccatgtggtagaaaatagactctttcttttggtggaatgagtgacaaagtcacatttcacaggtgcatgggtagaagaacaggaataactggagtcacaattgcaaatgatccacaataccctcttatagatgtttgactatttgtgcacttacctttatatacttacttaaaaattctagaggaagtgaaaatcgagacatactacttggatttagaaattcaaactactttgtgatggaagaaatggtctgtttcttattcatacataaagttcattatagataaaaatgttatcacctggcaaaatcagtttatttcttaatttaatgcctcttagttaccaagtagctgtttacaaataatgaacacacacaagaaacttttatgttgaatacataaataagaaaaaaaatgaataactacgtcttatctaatcactatattttctttcgtgtaatgctactagtatattcatgaaactaaacatttgaagataaaaatactttgtatgtgcattttaaacactatgagagacttcctaaattatttagcatattactgccatgctcatatattattctacatacttcaaataactatattggtttggaaatccataatactcagagatttccaaatttcacccattggaatacttaaatatgtattatttgatagggaacattcaagtatatccaaatatattctaaaaaccaccataaatatttcacaggtgtagaagaaataggtagtataggatgggttttgctgcattaatagacatcccaaatatctcaatggcttgatccaataaaataatttcatgccaagtatattgtacatctccctgacattccaggtcagctatgttggctcaaatttccaggatgcacaaatgttatgataccttgttttaggctgttcttgcattgctataaataaataccttatgttgggtaatttataaagaaaagaaagttaattggctcacgattctgtaggatgtgtaggaagaatggcactggcatctgctcagcttctggggatgcctgagggagcttttactcatggcagaagaggaagtgggagcaggcatctcacatggcaagaaccggagagaggcgggagatgccacacacttttaaatgaccagacctcccgagaactcgctatcgcaatgacaacaccaagccatgaaggatcctcccccaagatccagacacctccaaccaggccccatctccaatatgcggggttattttgtttcaacatgagatttgggcaaggacaaatatccaaactatatcatacctccatgaaagtcatgaaagagtcaaaagcaggttcacgagtcaaactcaagttatccattactttgatctgaaattagtacatattacttccatttactttgtattagccaaagcaagtcatgtggccactcctgtctttgcagggtgtggagtggtggcagtaagatgcagtccttgcactccttcagtatgtctgtaaggagaactggtaatattggtgaactgagctaatgtcccccactatagctgttattaatttgggtgattaaaaaaatcttagtcacactttttcaataggaaatttacagacttgaattccccatgaatgtgagagaaaagtgacatacaaatgatgctcttctggcctaacaaagaaaacataaatttgcagctttcagggagtgctatcaatttaaacgaattgctaggagtatagttattaagtaagatattttatcagaattccaggctttttaaaaattaaagtttatttttagaaggtatagcaactaccttgtgttcagggtgtcttaaatatttttatcacatgtaaggaaagttttaagcaaggaaagctttaagacagcagaagagtgtctattttgtatcctatagaagggactattttctcttgattttgtggaggtttcttttacggaaaaactaaaaagctttttgtttttaaagccaagtagtggatttaaaaagaaagaaggccagcaagaaaagtgtaaacttctgtaacatggtaaagaaagggccagaatgagattaaagtagagcatagggcatataatcttctgcatctacactgatgatatggtgtatattaagttttcctatggtcatatttttctcttgatcatctcccacattggatgcaataatgtctaaattcagagaaattatgctttaatttttcagttattgtacagggaagatctctatagaacacatgccagtcaactaggaagggtaaaatattaatatttccatatccataaatgcagaataacagatatactaatcagattatctggtcatcagctattaagaaataagttgacatcatatgaaggagggcaaatgagcaatacaaatctggtacttgtttcttaatatttcagagaaaaggagaaaagaaaaggcctatatacgaaggggactataatgaatcatttggtattcatatggcagcaaaggaaaaatgtttatatgtgagaagaaatgataatggtggtgaaaggtagcctagttgccctaaatataagacacagacttcaacattttgcataaaatggaccttggttattttatttcagtctattttactccaatcaaatgttgctgctctgagatttaagaatagtttgcccttaaatatgataatcccaaagtgagtagaattagcatgtatctgtttgaggtttgacatgtataaactttttgtcgtcatctgtttatgttaataacatcattttgttaaaattggacaagagctgtagaaagcacttgttgcttatttattcttatttactctcttagcttggttattttaaaataccatatttatttatggagaagttgcttgttatactagacttttcaagtgtacctcactgacaggaacttgacccaggaagaaaattgtgtgtttgtgtcagaaaatattaatcacatagaaatgtagattcagtgaccttcattgccctatcttttctcggatctcataaactgattttgggactccgatggcaaattttaatggaaaactgctataattgcttgtaggctttagagagtcagaatgcaacatcatgctgttcagtcagttcaaatcaacacccactacactattagatctatatacaggccagcagataggctgatattaccagagctgcaatctcttaggtgataaggtataaatcaaagcttaggaagctatatgtaagggaatatacaactcaaagccctttctgtttggcaatattaagataccacattgtttttcaccccaagtgaggtgaactagccacggaaaaattcaaacttctaaatatttgtcatctttctggaaaaaaaggggctagttatgctctgttaaaaaagtgactacttaagcgattaacatgacaatcttcattgaattttaacttatattgccaagatgcaagtttatccttcacattttgttgctaattttcaacataaatatgtgtatgccaagtgtttaaaaataatactctacattcttagatgtgacaaatatggcatgcactaatatctaagaatgaaagggaaggttactctgagaggctagatgtgtgtgctagtaggaatcaaatcatttttttcctctgtccttactcttaagctactaaaactcaggacttcatatttttttatgttatgttgatgttatgatctacagtgccagagaacccagcctattagccttaagctcatccattcttgctgagtatgcttcttacactactggccattttgtaaacatgtcccatttgtcaaaatacagacatgggaggtatagattgctattcattgcatgtgctgaaaaaaactgctgaccatggacattttattgaatgcctctgcaacaccatcttgaaatataacaaatcgtatatgagaaagtaataaagaaggattgcttcaaatttgttaatttacctattttcctcaagcacatgtacgtccattgtccgaacagaaagagaaaaaagcaatatctttggcactagcttccagtggattccctggagctaactgtgtaaacaactgctgtctctgaccttttgttgcaagcatttacaaaagtagtacattttaaacatatgttgaatataaggctttatgttctgcaatgggtatgtagcagtaaatgaggcagatataatctgggagtcaaatgttattaaactctagcagctctgcaaggtactttataacatgagaaacacacccagccacccacccctattccccaaacacagaaatatagttggtaaaaaaaatgcaaaacagcaaagtgtcagttcaattggtgagcataaattcattaccacaggcaagtaatttcatggctatttgaaacacaagaaataactctagaagtaaagaaatatgagtgatggagagttgtacctagagaagctctcagcctggaataatacattttacacaacccacagaaaaatgcaaatagaaagatgttgttggatatgctcaagcggaatggtgaaataaaaccgggcagaaaaaaaagacaatcttagtcacttaatactaagtgttttgccagtacactggtgaaatatacaaatagttaacaacagaagtgctgaacttcatatgaccattaagattattctttgatatttatacataatttttcaagcctaatacctttaattctatagaaaatcccctttcctccccagatttatgcaaacagcatagaatctttattctcatggtaaattcttgttcctcctactttccaccaacaaactttagatctaatatcttattgcttttgctaagttatgtgcaaatgtgaaactcagcctgtattccttaattactgaaaaaagcacttgtttgtatcatcaatgtatgtagcatattttaaagggtgtttattcatgaagatttctatcaaataatatcttaaatttccatattaatttatgtttgcaaaagatttttaaaccccttccgcaggtatttttcccactggcaagctttctcagaatagatgttctaaaaagattgctgggtgtcgttaaaagaaaactaggcattgtataagcacatacttctggactttctgacccatatagggtcactttacctttcctagtttttgagctctttgacaactctgttagttgtagaaactgacagcaatatgaatgattcttgtccataatcataccaatatattttgtccattagaaatgcaattaatctctctctctacaaaccactgttacatttcattataaatatatttcagcatcatttaatgcttatatatgtgtggttctttgaatgtcctttgaactagttgcaacatactagttactggttcccatatcaattagcaaatttaaaagtatgtttggcatgtgctcattctatatttgtgtgagaaaagattatgaactcttgaaactgtaactttcaggatctaatacaatttactaaattcattctgtccttctagataacccatctacccctgcttcttcattttcagaaattttttgtgtgtactatcacagaatcaattaccattagacttatttgaataatatatccaaggatgtatttttgtgcacacttaaaaaccataatacccaggtttctactttaagcatctgaaaataatttgaagaaatgataaaattctatatattttctaaagttccgtatgttgttctctttcccccattagtgtatgtaatttgaagagagcagaatagatatatacttcctattgatacagcttatgccatggctattagaaataagaagtatcaaccatgtagtctgacttttttaaccctgattcatgcctgcagtatatatggaagtttaagttgttatatgttgatatgggattgattttataatgttgaatgagtacttcttaaataattttcttattttattacctttttgatttctagaattgaaagaatctctaattcttagatgtccttcagccagggggcctacaaatacaggccagcaataaaaataaaatgataaatccttctccatcttttttttcttttctcctgtgggagccttctctaggatgactcatgtccattcttattctaggcaataatgaaccttactacaaagttgtggtcagtttcattttgcaaagccataaaaagttatgaattaatcacaactttatagtttggaacattattcacctatgtttagaagctcaaactttaaagttcatcaggggaacccgcccttgataattcatcgttatttcatgtaggttcttttctatttccctaaatgttggccggtctgagaaataaagggaaagagtacaaaagagagaaattttaaagctgggtgtccgggggagacatcacatgtcagcaggttccatgatgccccctgagccgtaaaaccagcaagtttttattagcaattttcaaaggggagggaatgtatgaatagggtgtgggtcacagagatcacatgcttcaagggcgacaaaagatcacaaggcagaaggtccgggcgaaactagaatcactaatgaacttccatgtcctgctgtgcacgcattgtcagggttcaagagcagagaaccggactgactagaattcaccaggctggaatttcttaatcctagcaagcctggggccactgcaggaggccagggcgcatttcatcccttacctgcaactgcataaggcaaacattcctagggcggccattttagaggcccccccgggaatgcattcttttcccagggctgttaattattaatattccttaattaatatggctctgtcctgcccggcccacaggcagccagactttaaggttatctcccttgtttcctgaaaatcgctattatcctgttcttaaggtgcccagatttcatattgttcaaacacacatgctctacaaacaatttgtgcagttaatgcaatcatcacagggtcctgaggtgacatacatcctcagcgtacaaagatgacgggattaagagattaaagtaaagacaggcataggaaattataagagtattgattggggaagtgataaatgtccatgaaatcttcacaatttatgttcttctgtcacaacttcagcaggtgcctccattcggggttcctgacttcccgcaacaaagtaagagaatgttcatattcataggaaggaagaactgacaggatggctgaaatctcatgtgacttgaaaacttgttatattcaactgtaatcataagtgtacccgaacccatatcagtcttcactctggccatcaacacagtagctgtattagagtaatggaaaaatatagtggaaaaatgagaactgttaaaagaaatttaactcgtacagatttcaccttcctttaggtactttgctattaaataaaatgtgaaagaatataaatatatgaacatgaagataatattaaaaataatcattttttaaaacaatgggatatatgtcttcctgtcttcctacatataggaaactctgttggcttaagaggaactgccaaaacattatttatctagtgaccaaataacatggaaagattccttaaatcgtgaattaatataagaagtgctcctttgaaaagtaaagctattgcttacaaaatctaagaaaaaaaccctttattcaggttataaaccatatgattatatttatcttttaagttttcatgaagaaaatgttcatagttttaatgaaaatgagaaactggaattgaaatgttatattattatagtcaaaaatgaactgcatataaattatactgattcaagtttctattaatgcaaaaatatgtaattgggtcattattatttataaaacacaataacaaatgaaacatttagctttaaatgcttactgtagcatatattgaactatgaattaactgtccatttatcaaaataaatagaaaaagcaaatactatgggatacaagggtaaaaaatgaacaccacatggactgagtctatctatgtgctgactgtgacacagcggagtcaataattccatcttcaattctgctttgttggtcacagctggactaatcatgcaataagctgcacagatcataaagacagccaatataatcatgtaggtcaggagggttgcccatcagtctgcttaatgtgaatatgatcggaatcaaaagaagctggccacaatgaaagaaattacctagaaatgtagatcaaagagatataatcagcattagtaattcatccctgaatacaaatgcagaatatagactattacttttcacagaactttcaactaaccctgctttgtcaatgtacaatgatccttcatgaagattttcttacacagagacagcttggaagtttccagaaaaattgactgtcaaaaaacttaacttgtcttaggtaaagattgatcattttatttttcttttaaatcattggaatgggaaatattctatttctttttcacaatcctatactcacacacacaaatatacacacacatgtatgtacagaaattcatacatacaatactcttactctgttgtgctgccttaaagaagaaaactaaacccagaaccagaagtaatcctaatgttattataaaaatttgcaaaatattcatgaagattatacattttaaaatttcagattttattttagaaggagtatttcttctggacagatgtatttactaaaattgatgttttgctttgttgtgtctgtgtgaaaataagtgttttttaatgacgtaaaatttgcacacaataaaatacacttcttaagtgaacagatggatgaacttcgaaaatagcatacatgtatgtaatccatacagctatcaaaacattgacaatgttgaatttcaccagggctctatgattccgtaaacagctacgattaaatctctttaatcatttatgttccatttggcttactgcaaagaaacaccattcctcatatgactttgataagacacatatatgccccctctttacctattacaaggctggtcacagacccttccaatttccattctttgtctcataaatgattaaccaaacacttgtccccacttaacaattggaacaaaatccttgttaaacaaacttggatttagtttctctcctttcctagatccctgaactttgacctacctttaccctgagccagtataatgcccctccttatcagccccttctgaaaataagctgacttcagggtacagcattctctggtctactatccaagcacaacaccctttttcataccactttcgccagcctgcttctctctagccctagcctttgttacttctctctttaaataaaagctttgtttctaataaactttgagacatttacagatctcatggttccagtgatcttcctgttgcaatagtccccttccttcattgcaataatcctttcaaccaaagtccctgcaacctaggtctacatttgtttttatttgagaacatagaacattttctttaccccaggaagactcctcatttccttcccagtaaatccctgccccatcctttaaagaggtaaatcctgctttgattttttcttttttaagaaaaaagaaacattttaagaaaatgtgttgcaacacttctagaacttgaagtgtgataatgaagaaagtacttttgtaccgctttctttggctcagtataacagcagcactactgctattatagtatagataattattaatatttgtcgtggagattgtcttgtgcactgtaggatgttcagcaacatccctctagttttctgaagctcctctctgaacactttcctttctcatccgtatcaagtccctaaaattagagttatgacaatagcctggaatgataatctatttctgctctgctcaagtagtccatatttatttgtttggactccacttcctttggttgcagtctagaaaatcattatcctcagcaaactaacaggaacagacaaccaaacaccgcatgttctcattcctaagtgggaactgaacaatgagaacacatggatatcacgtgcgtccatgtgaagagaccaccaaactggctttgtgtgagcaagaaagctttttaatcacctgggtgcaggcaggctgagtccgaaaagagagtcaacgaagggagatagaggtggggccgttttataggatttgggtaggtaatggaaaattacagtcaaagggggttgttctctggcggcaggggtgggggtcacaaggtgctcagtgggggagcttatgagccaggagaaggaatttcacaaggtaatgtcatcggttaaggcaggaaccggccattttcacttcttttgtgattcttcacttgcttcaggccatctggatgtgtaggtgcaggcttgggctcagaggcctgacaatggacgcagggaggggagcaacactcactggggcctgttgcgggagggcagagtgagagcattagggaaaagagctaatgcatgttgcccttaatacctaggtgatgggttgttaggtgcagcaaaccaccatggcacacgtttacccatgcaacaaacatgcacatcctgcacatgtgccccagaacttaaaaaaaaatacttttttttttagaaaaagaaaacatctgttgtcagaaagttggagagatggcagagatcatcttgtttctcttctctcaaagatcacagtcttattctacttattgtcaaacatctaaacaaagttatttgatattttttattgtgggggttagtacaatatcagcttctcctccatggccaaagtgaaactcctattaagtctattttaactgggctttctaccttccctaataaattattttagagtcttaataaaaagatatttgagtaaactggtgacaccaataaaatggtaaagatttagaatcttttgtgtaagtttaggtttatttttcaaagtaatttttatattttagttcaagtctaagattcatagaagtaaatttacaaacaggctaattcttaataactgaagatataattacacattgattcttttccttttcacacacactaacatgagttcctctgcccatgttttaaaaatattaattggtgtctttaccatatgcctagaggaattgagtcacaaagggtgtcatagagaaacacattggaggctaatatcagcaagccagtgaattaagtctgataggttattaaaatgtaggtaccaacatggctatgaaaaattaatgataaaactattgggtaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccaccgcagtccgcagtccggcctgggcgacagagcgagactccgtctcaaaaaaaaaaaaaaaaaaaaaaaaaaaaaaactattgggtataagaaagcaaggaatacaataataagcaatgtttcagccaaagaatggaataaattagcatatataaatatcaggggccagtagcacttatggtatgctttttcaaacttaaatctggtgtcatttttaaagggtgctatttctgggggaaatgaaacactcctccatttaaataattgatgaatcccattaattctgtcttcatagaatatccttaatccatgtttgtctccacattcttactgtcacatgttatatctcatattgtccttggttgatataatagtctcttatcagggttctttctttctgatcttttcccattctagtgtatcctacatattgctgacaaatttagattttgtagctaattgttccacaaacttttaatggcttcccacaaactacagaataaagattatattccatagcctcaaattgcatatgctgtttaatttgaggccaaatgatcttttctgcttcatccttatactctgctgagtcaacctactcattattccacaaatatgcacataagcatgacactgttgttccttctgttacttattcccactttgtttgttataagaatctttcctcaaccacattaaagagcaagaatggagtcatatttatccttgtgttgccaatatagcctagtctcagatgaagttcagcaaatgtggtgagatagagttcccactctcagttctttgaaaactaggatttttatgatgtgtgacagctcagagcaatgtgttatctcaataatgaatcttcattgagctaggtaggttctaggcttatgatccatctaattccactccaagtacaaattagacagatattgtttttgtgttccagataaatattacacagatttctgccagagccagaggaaactcaggtagcaagattgttatcacattccctaagttttaattctgaatgtcagcctgtttctaataggcctcagtgaactaaccaggaggacatattttaaaaataaataaatgaataaataaactttgaacccatttatcttttgcctaaaagaaacccacttcacctataaagacacatatagactgaaaataatggaatggaaaaagttattccatgccaatggaaaccaaaaaagagcatcacttgctatagttatatcagacaaaatagattgccagacaaaaactataagaagaaacaaagaagatcattaggtaatgataaaagttcaattcagcaagaggagataacaattttatgtatgtatgcatctaacactggagtgcccatatataaagaaaatactattagaccttaaaagaaagatggaccccaatgcaacaatagccagagattttaataccctacttgcagcattgaccagatcttccagacagaaaatcagcaaagaaacatcagatgtaatctgcaatatagacaaaatggatctaatagatgttttcagaacatttcatctaagagctacagaatacacattctttcctcagcatgtgaatcattctcaaggataggccacatgttaggccacaaaacaagtcttaaaacattcaaaaaattgaaataatatcagcatcttatctgaccacaatgcaataaaactagaaattaataacaagaagaatttaggaacccctacaaatacgtgcaaattaaacaatatgcttctgaatgaccagtgggtcaatgaagaaattaagaaaggaattaaaaattttcttgaaacaaatgataatggaaacacaacatttcaaaacctataggatacagcaaaagcagaactaacagagaagtttatagctacaagttcctacatcactgccacctccacctcccaggttcaagcgattctcctgcctcaacctcttgagtagctgagactccaggcatgcaccaccacgcccaactgatttttgtatttttttttttttttttttagtagagatggggtttcaccatgttagccaggatggtctcgatctcttgaccttgtgatctgcctgtcctggcctttcaaagtgctgggattacagactaagtattctaatatttgttatatatacaggaatcctgatcacccttgggaagtgattttcctgagtttgatcacaacccaacttgatagctatatggcaagtaactctttcacttgcctttcttccatgccactctggtgtattcatcaaaaagtacttttcccttgtcagctactgagacttctattctctatgataaaagattccatatccttattccaaacaacttgcttaccaatcccatcttatccagatccattagtgaacctccttgcattatattgtaacaatggccaaactacgtaggtctctcttgaaaacaacatgactaattcatattatattattcctgtgaaatttatacataaaaatgctacttgtactctaccccaaatccacaatttcccatgacctatggctttcactcctgatattttttgcaatatcaacagcagtactgtcctcctaaccaatcagaaactggaggagctacagggtatctattaatttctgtaagacatcttctaatacacaagaaagtaacacaaaccttatcttcatagaaccccttcataagaagaaatgcatggctcatctgatatttacaacatcccctcccttccaaaccctgtacaacaatttattggatcattcaagttgataaaattaattagctatatcacatagtttcttcaattttttccaactactaatatgtaaatatggcacaatatctcactggattcacaaccaatccaacgtatgaaacaatgaagttgttcaacccagaagagtcaagtttttcatcaggtggactgtccatgccaccctaaccagactgaaggaatttgaaggactgaaggtttcagctctgttactgacttcttaaagccataaaaactcttcctgattcaagtgtctgatgagaatgattccaacagcctctccccctccttcattttttggtcaatctttacccaaatctaaattcctgtcccagtagtcttaatctcttagaattattgttaatttttggctctttggcatatccaaactaaacattaacacaacccagagaagaatgcacagcatagaaagaaataggagctatattttattccctcccaggaatgatctgtttaaatatgctcttgagtaagacatatattgagcaaaacgaatatttcttttaagctggaatgtcctttttctatataccatagtccaactaatatgaatatatatataaagttatttaaagttttataaaatagtcaagttgtaaatttaaaattctcttcaacacatatatatacataccaacacacacaaaataaagaattaaacatttctaataatgattatataaaatccacacttaccatacaccgtatgttgagttgcagattcagagataatattaacatgtgaacatgtatgtcaaattgttagtaattagaaaaatatgtgctaggtgcagcagctcatgcctgtaatctcaacactttgggaggctgatgcaggaaaataacttaaggccaggaaatcgataccatcctggacaacatatcaagaccttgtctcaactaaaaataaaaaataaagaagttatccaggcatggtggtgcatgcctgtagtctcactcaggaggctgaggcaggaggatcacttgatcccaggaggtccaggctgtagtgagctgtggtggtgccactgcactccagcccgagtgacagggaaagaccttgtctcaattaaaaagaataatgaaaagagagaaaatcacaggagttcaggaacaatgggcacacatgtattctatttttttcatcattttacctacaatgaatatgtgaaagaaccatatagaaattccatcattgtcaggtattatgaagttttgctactaatcaggttttctgagttttttaagttaaaagggtcttaaaatattttattattatcatattgtcagtaattctcttccacatgctaatattaaagcaagttatatagtaagaataccagttaagattctgtgtttgataatcctctatggttcctacccagtgagaatgatataggactacaaatacccagattcaattctattctattccattctaagtggaaagcaattcaagagaagagctgctgtgctcttaccaggggtgtaacagggcccataattccttaactctcattgaaatacttttttctaggttttatttcagcataagttatttcaaaaaataatacacatattttaaaagatatttctaccagtagttattaagcaaacactcatggaacctccatttaagtcaaaaacaatatcaaccacctgccagaaaatttcaatttattccttattaatttgagcaccttccttaagttatcttaatattttggtaataatttccttcttttccctgtcattttaacaccagtgatgcatcactaactgatattttattcctatggttataaagtataatgtatatgttgtttctcatccttttttgttcattattttgttgctaaaattcatcaagtggtgtgtatctatagttcatcaatcttcactaattttatttatccattctgctgtcctgagtaattgggatgtttccaggtttttggcgattaaattcaatattatgaatatactggatatgtgtatctggtacatataagcacttaggtctccagggaaacactaatataactgtctgcattgatttaaatgatctatttgtcctgtccaatatagtagccaatagctgctggtggctattgagcattttaaatacagcaagtgaaactagggaacaaagtcttaattttatttcatttcattatgattaaattttatacttaaatagatacatgtgactagtgtctgtcatttgataccactgactaacttgacaagtattttaatattaaagatccctggacttgaaaggtgaaataagtacttctgattgcacaagagagtttacaacaagaaaattaaaattaaaattcaggactttaaataattatctcaagtgacagtcaaatgaacagagggtttatatgtcagccttaaaaaaccatctcttatttcttataacatcagaagcaacatatctaaaaataggaccccaaattaactgcaatatttgtaaaattgcagtgaaaatttaattcatagattgtcaagtttcagatgtaaaatttatagcatccattggaaagtagtgggactttaggaattaaatgtgaatatcttttaaaaagaaatctaaagatgaaaaagatataagagacttagactttcaagtctccctgatgttcccttgctgctggaagctgactctccttctgcccttgaagagactaggctttacttatgttaaggcaatataataacatcaactcaggcagctgttttgcaagtagatacatattctcctcaagtctcatcacaaccattccttatttgctatagaactataaataactttagacaagggtatgctctgaagcaaaagtgctaagttagacctagaaagaaatacagtgtattccaaaagtatttcagaaattggggaaatatttgcaagagtagattctgagggaatctctggtcttgaagcaagtaggatattataaattattgggctaggctcaatttactgatatggatacaccaagcaaaaatttgagatgacatatattaaagtgaattggaaatgactctaagaatttatttcattggttaattgaaacttggacttgtgaaggcttttattcaatgatgttgagatgctagaacttttatggcatacattagtgaaagaaatacaaagatttagagagatagggatattgtaatggctttgtcatgtacatattaaatatctatctctaccactatcttcaataagtcccagaaaccatgccctttactgaggatctgtgaaatatagtcatgcattgcttaacaacggggatatatactcgcaaatatgtcatttgagggttttgttgtcatgcaaacatcatagagtgcacttacaaaaacctaggtggtatagcctactatacacctaagctatacacctaacctaaacctatttgttcctagactatgaacctgtacagcatgttactgtactaaatactgtaggtaattgtaatacaacgtaagtagttgtgtatctaaacatatcaaaatatagaaaaggtacagtgaatatatagtataatagattaaaaatgatgtatctggatagtgcagttaccatgaatgtagcttgtatgaccggaagttgttcttagtgagtgagtgaatagtgagtgaatgtgaatgcctagaacattactgtatactactttaggctctatgaccacagtacacttagactacactaaatttatgaaaacgtatttttcttccttcaataataaatttaccttagcttactgtaagtttttaccttataaacttttaaatttataaaggtagaacgagtacttttgattgacaggagagcttacaccttaaaaggggtacttaagtacttattccagcattttaacttcttgactcttttgtaataacacttagcttaaaacacagacacattgtatagctgtacaaaaatattttctttctttattttcttattctatatgcttttttccatgtttagtgttttttatttatttatttttacttttgaaacttttttgttaaaaactaagacacagacacacactttagcctaggcctacatagggtcaggattaccaatatcactgtcttctacctccacaccttgtcccccactggaagggcttcaggggcaataacatgcatggagctgtcatcttctatataacaatacctttttctgggtacctcctaaaggacctgcctgaggctgtttacaatgagcattttttataagtaggagtatactctaaaatagcagtaaaatatagtatagtaaatactaggtgatagaaatattttagctcctgtataatcttatggaaccactgtggtttatgcagtccattactgactgaaacatcagtaagtggcccatactgtaacttcaggtgggaacttcagcttcttggaaatgttctgtggtatctttcttttgtactgcagattgtaggagatgtcaccattagtctaccaatttcagtggggttaacagtatttcagagtgacaaaggctaagttacagtgtttaatgatcttagacaaggtggacacatttaacaaaacggacagcagaaacaaaatggtaattacaatattttgacctataggatctttggcagtaggatattcatcaaataaattttatatatgagcagtctataaaaatattacttcacctctataacaaaaaaatgtctaggccttttagccagaaactggacttgagttgtcaaatggtgactcactcccacgtttctggacttaagccagttcatgaactttaggcccttggactgatagagagtccgggcccccttgaggaagagccctgcaagactgtgaatatttcttgaagccatctccaacattatctaacgtcatttacaaaggttattgcatactggagaaagagaaatatccagatgtttcagagattactagacactcatatgaattgacaataattgctgggaaccaaaactatctctctggtctattagttaaataaaaacatggaggttagggataagagtagaattgacctaagtcagtctcttatagggccagtagagcaaaaactcactctgtggctatgtttttcccagttctttaatgtgtaattacctccttcaaccatagatgacagtgagaataaaaaggaccaaatgcaagttgttttgacttcctctcttcaccaggaaaattaaccaaaagcgcttctgattcccagagaaaactgctgagttgagtcctaccgtcaaagacttgaaaaaatatatatattcaatttaactcatttgtttgccctgcacatatcttggagactgactgtgtaactgactgacatctgattgtaaacttaacagatgttgatttaatttacagccactgttacagctgtggtacctttactggaacaaatcaacacaactctagcatggagaaataattatcgatctggcaaatgcttttttctctacatggatttgcgaggcacagtagcagaagatcattttcactgcattgtttcagggctgtgtcaatgtgcctacttcctgccataaggaggttaacaggatgttcatgatgatatgcctcagaataccatagttcactatattgataacatcaaattgactggacctgatgaacagcaattaataagatatattttggtaaaatacatgggcatttagtgtatatccctgagccaatgggcagacaaggaggttattccactggctgaagtggttatttgagactgccaagaaaaaaatggtattgctgatacatgatgggaaagaataagctatgctggcaacccagcagattctttaggattctctattactttattgtacgatagcaaatgctaatagaaaagtttagcaaccaaaacacccccatagaaaaaatgaggagtcaaatcttttagtaatgtagttttaggttatcctgacaggtaaagaatccagattgattaaagcttttcctgaggacaaaaataatacggaatagtttgaaagaaggaacgtatatcaactcaggccttttttaacctacagaaataacagacacatcagatatgcatattttctttcttgattgttatgtgtgtatatatatgtacatgtaatgatattttttttatcccttatcctttccagttactattttatatgaggatctggggtatagttaactttactacttagtgtttaggttacagagcatttggaatagcttgtgacagagctagaaatggatttcacattgcccagggacgcatactttatttgttaagactcttttaggaaagaagaggtgaatgtctttgtataaaacattggcacatcttgttagcagaaccatgaagaagccattattgctgctatgtagaagttcaaacatgtggtgtggtttataatttaatgcaacgtagccaaaggggaggactgtgtcagtcacttatgtagcatactctactccaaatccaccatttaataatattttacatgataggcctgtgtaaaaaaaaaaaaaaatgcttacctttggccagcaaaggcactagagaagattggaaggcaacaggaaagaagaagagatatctttgctgttcctgctaataaaataaataccagtataaaaattttgccttcgtagctgcagttacttgcagcttacatttactttctgaaatcccagaactaatggcattgttccctaccattggtgttcaatgttgttgaaaaaaaaggaatgaataaatacatcaatgtcagggttgagattaattcaatataatatttattccaacttatttattacacagaaattcttgagaaatatacttgtttacatcaagtaactaagagaaacaaaaatattgaagaataaaaaattaagcataataaatataaagttcaagaaatctcctatttttctttaaaatccacaagaaattatatatgtgtaatctacatgtggtagttagggaagagttaaacagcaaatttctaactgtagcaagcaaatagggaaacattttcattcataatgaaaataatgaaaatgccatgaagagaaaggtagttgaattatgagggaaatatttctaaaaaacacttagctagaaatatatttttcctccacctgaaaacataaaagttccatcatgtttcttattgaagagacttacaaaaataattatatgggtgaactacatttctagacattattatacttcatagacttttaccagagcaattaagaacatcagtaggataacatacactaaataaaattgatgaactttaggtaatcaagtcgagttgacactttaaaagcactgagtaattacagagaagaaaattagtccatagtctagcaacacggagatgaacctgtttgatatggactagaaatagacatagaactgaacaaattgggttagagacagatccaggaactaaatactttgtgtatcctgacttccagtgcaatgatacatgaggtaggtactgtactcatagaacctatcgagcatctagacaaaatgtagattcttattcagtacattctacatttctaacaagttctcaagttaaatggatggagatgtagaggactctgccttaccattccttttccacaataaatactactatgaccaacaaatgaaatatagtaaaagatcattggtggataaaatacataatattgataatattattgatgaataatactcccgaataaaaaaatgaatctatcactttagtagacgtgaagtactttcaaaatttataaataatacattttaggaagcctgcaagcctgggtacctttttcagagaatttccatctttagcacactaacagaagtgggaatctaaaatgcttcaatacataacttcttcctgtgattatggctaaacagacctcttatccagggcaagacacatagtttctgtcctctgggaatttggaggacagattcatttataacttattgtggacactagttatagaaggtcatgtaacctcaagggttgaaagtgacctcatttgcatttcaacattatggattgtggtcaataaaagaaaaggaaggcaggatgcagagaagggagcaacacagacataagcagaaaaagaaaaggaaaatccataaagcaaacaggagatgttaaggtgaagcgaccttggtcacggaagacttttcatattttgtgttgagtttcaggtaaggctgtttgccgctttgcttttcctgaaatttcctttattttttccttcaaattaactccagtgattttctggagttttgttttgttttgtttttgcaaccaaaggatcccctcacaagaaagctcagaatccgttattcttttcaagaggtggggaaactgagaccaaggtatcttctaagtaattctaacccaagatcatgtatctaggaggtttaaccactcctcagcccccagtcagaaatgacaagatcattctaaaagaatgtgcacccatgcagtcactcatacaataaattcatatcaagaaatatactctgtggaaaatgtataccttgtgagaacatgtatgttgggatattgatatggtcacaaaaacttggagagaaaacagtaaatatacaaaagtgaggaagtagttatttaaatcatagtatagcatttcctttacattatatgcaggcattttaaatgattattacaaaactacataacaatattgacatttctaggacaaaatgtttagttcttaaaaacagaaaacaagtgtttattaaaggtcttgcaacctagtaaaatttatatgtgtatggataagtatggaagaaatcaggtcgtctgctcttgagttttagtttgtgaaatgtatgaaaatggctataaaatcaaccttttctacccataatattataatatttatctgtgaaataaatatggatgataagttaatttattgtaggccaaaatatgtaaaacatgaacttaggaaaatacaaaacacttccatcttccacaatttcattagctagaaaaacaatttatgaagataaatagtgagaactattagggaaatattaatgttagtcattaccagtagctaaacttttaaaacaattttgaaaaattgtggaatcctataaagtaatttagcctgtggcttataaaagtaaattatttcatttaatttaatgcaacaaacatctgtatgacaatgtaattgggcctaatgaaaaagataaaacaatctactctcaagaaatttgtagtcaagtgggaaaatagatataaaataatatatcataatgtattgggtggaacagtattaatatatcaagcacacagttccatttcttgaatttttgaataaatttccttgatatctgccccattgcctaataactaagttgccttttctgttttaaaacatggctttccttttatcatatctccataacatttatgtatttgtcaaaggtatttccttctacaaaatgtgtcccatttgtccatcatgctatcctactaattctcattccagcaaccatgctgttcaaatgactgtgactgatcaggaggcttaattaacttgtcaagggaaagatagttgttttcagtccattttcacttttccatatggcaaaaaagtccatctccagcatgcatttatagatatatgtgctgcattgtgaaatgatggcaaattatctaaacttaccccctagaaattagaatgagggctacaaataaataataataaacaccaaaggtttcttttattttttttttcagagatttacatcccaataggtgaaagagtaaccccatcttctttgccagtgctagtttcagaaatagatgtgtaatgtgatttagaacattgagacacaaaggaaggttttgctcaggggttctgggaaagctcttctatattcttttgatttttttttttaacagacagtctcactttgtcacccaggctcaagtgcagtggcacaatcatagctcactgcaaccttaaactcctgtgctcctgtctcagtaagtgggactacaggctcctgtcatcacttctgcctatttttttatacatatatatttctttagatataaggtctccctatgttgctcaggctggtctcaaaatcctggcctcaagcaatcctcctgcctcagtcaccagagccaccacatcagggctgaaattattattcatttatttatttatgcattttagaagcagctctcccctttcttttttctctgttccttttttgatatggggtctgaatttgagtaagccatcttgctcctagtctatgaatgaagccagccaccagtagagaaaagagcaaagagaatctgtgagcaaaggaacacaattgccaactctgaagactgcttatgtgttatgagacaacacattttcatgtttaagctattttggttttggctttgttgttttctgtgaagacattcattcattcactgacaaatatttactgtgcaattaatatgaactaggaaatgttctaagggttgggtgacacaagaagtgggaaaaaaagctaaaaatttctaccttcatagagaccacattctactggattataatgaaatcattctacctgatgaagatttataatagtgattttgaaataaattcataatttggaatcagtcctaggacatagatacaccttaaagtgcaaaactttttaaaattttgagaagaaaattacatagttatagcagaagctgttgaggtcacctttagttcccattcatgtctatggattcctctgcctattctctggatataagagtccagaaatgccatgagggagagtgaatgctccagatgcaatcttcaaccaatcaggaatgggagtcggcgggtttatgtcccagctccctgacccctcagtgtagaaattcgaaggtttattctcccatggatttaacctgatcactaatgcaccctttagattccttactaccttcttggtttcactttcccactttgatgccatattttctgaaatcacctctcaaataaaccacttgtaccaaaatccttgtcaaagagtccacatttggaggaacccaaactaagatgatggtaaatacagctatcaattgtgtatctcttcttctccatgcttcttctttaaatttaagctgcagcattctccagtgatacagaaataccaggataaaaacaagacaagagaatttctctccttcattctattgttcttccactctttccttcttttttttttttcattttcagacaatatcctgggccttacataaatatccacagtacttattagtcctgtttaattttctgtgactaattcttctgataggtctttctgcccaaaatacgtagcatagattggagactacagagaagtcagccaatcacagggaacacagtgagtaatgtgttatgttgataatataacgatcactccatcctgtttatatgtatctgtgttgactccctgtaaaagcagcagcccaatgccaggaaaaaaattgaagataaactttcctgtgacaacataaggtgttttatttttattttcatttttaatcagaagacaaaaaataaaaactactttcacaactacttaaggatctttgtaaagtttttttgcagttttattaaaatcttggtaacagaaatgcatatatttttattccttgtgtcttatagcccatgaagttttaaagtatgtcagctggttttcattttctatatttaattcttccttttttttcttactggcatagagctggcataattcactgaaattattcactaaattcagttattttaaatttgaaatactaacattctttccagttcattgagcaaattgtatacgacacaaaccttttagtaattgtgaagttaagctgaatttatgcagggtagattctctgctaaattgaaaataattctaggatgtatgtctggttctgtgtgtgcgtgtgtgtgaccatgtgttcatgaatgagctcaggtatgtatgcttggaggagaacgtgaggtgaagagggtcatttcagacaaacttctatagtgtttgttttggattaaattagactgctagtctgaactaagaagtagtatttctcctaattaatcaagctagtcctaggtacattttgcatatcattcattctgaccaaatgggaaacactatccgtattccccttaattattaatctatgctgtttctatcaaaagggcacagataaaaggcttgaagagcttccaatttgaaattaatctttttaacttccagtaagttattggggtggcccacagaatcaaggtacctcttatattgtaaaatctttacaagtacctgtttcccaaatgggctttacctctgcatcatcaaaacctagagcccaggccatgatgacttgggaagctggtgaaattcctagttagcattttatgaagtacatggccttaactaagaagaagtcaattttaacattcaagaaatgtcaatggtagtgggcctcaatctttatgattcatgaggttcaaggactgtagctggtgcccggaatttagcaagtggtgcctatctacatataacttggccttttatcttaaccagaactctcagaaactgtagagcaagtagctctgttgcttatagcctttgaagtataagcatgtatgaaactgaataacttctaccaattctgattagcctgcctccgttggactacagctttggaacttatgagaggaatcatcacttaaatgtattactttgaagcacaaatacctgcaaaactgaactccaattaatcctagtcttatatgtggctatccgaacaaggttccttcattcagccagactctagactttaaactggacacataaatgtattggccaccatattagcagccttataatcaagcccacataccaggcattgtggaggaaacagtacagttgaatcatttactccaactcaatctgcaggaaattgtcttcatgttttctagttatttctgcccttgtctttgcatgtctctagtgttctgatcttaaaagcaattatgtgatacatattttcccagtgaaaccccttattctctgatgttatagctggatgaaatgcaaatatgcttcacataccatctaaaagaaacatcagataagacaccatagaaggacagatagaactattcaaaagtgacagtcaagtttagtgcaggaaataaaaagcccccttcccttaatgcatgtcagcaaaccaaaaagaataatgggaacatcgttgtataaatggatgctatttaatgtccagtgctcaagtcttacatattttatcaatgaagaaaaatgactgcagagaaaccaccaaaaagaaatttaatttgcttgaacatcagagcaggctttaaaaagcagaatgaaagttttcaaagctattgctatttctcagcttcccatattactgggaaaaaattgctggcaaataccatgtcaaaaggtcattcaactttttagaagatgcttgtttgaaaattcttatttctctcaatctctatggattccttaatcctaccatctttttgtgtctgcaatgaattttagtataaaggaatggctttctagatgaaagaagtcaaatatatttagaaagagccattgaaattccaaggacattttctttcttgtgtttcttgcttttgaagatatgaatagaacaaataaagtttataataaatccagatattttcttttttttttttttctctttaacaatttattcttctattgactaggaattgaaatggtcatacttcggctctatctggttaaataaaatgttttattataataaatctcacctgtttctactttttttttttttttatattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcagttcccacctatgagtgagaatatgcggtgtttggttttttgttcttgcgatagtttactgagaatgatggtttccagtctcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcatttgggtatatacccagtaatgggatggctgggtcaaatggtatttctagttctacatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtagattgcaaaaatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatgtgaactttaaagcagttttttccaattctgtgaagaaagtcattggtagcttgatggggatggcattgaatctgtaaattaccttgggcagtagggccattttcacgatattgattcttcctacccatgagcatggaatgttcttccatttgtttgtatcctcttttatttccttgagcagtggtttgtagttctcctcaaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagatgatggggttttctagataaacaatcatgtcgtctgcaaacagggacaatttgacttcctcttttcctaattgaataccttttatttccttctcctgcatgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggagttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgtgtagaggtgtttgtagtattctctgatggtagtttgtatttctgtggtatcggtggtgatgtcccctttatcattttttattgtgtctatttgattcttctctctttttttctttattagtcttgctagtggtctatcaattttgttgatcctctcaaaaaaccagctcctagattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttcttgttggtttcaaagaacatctttatttctgccttcatttcgttatgtacccagtagtcattcaggagcaggttgttcagtttccatgtagttgagcggctttgagtgagattcttaatcctgagttctagtttgatcgcactgtggtctgagagatagtttggtataatttctgttcttttacatttgctgaggagagttttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctgttttgatctttgttggtttgaagtctgttttatcagagactaggattgcaacccctgccttcttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattggagcatttagtccatttacatttaaagttaatattgttatgtgtgaatttgatcctgtcattatgatgttagctggtgattttgctcgttagttgatgcagtttcttcctagtctcaatggtctttacattttggcatgattttgcagcggctggtaccggttgttcctttccatgtttagcgcttccttcaggagctcttttagggctggcttggtggtgacaacatctctcagcatttgcttgtctgtaaagtattttatttctccttcacttatgaagcttagtttggctggatatgaaattctgggttgaaaattcttttccttaagaatgttgaatattggcccccactctcttctggcttgtagggtttctgccgagagagccgctgttagtctgatgggcttccctttgagggtaacccgacctttctctctggctgcccttaacattttttccttcatttcaactttggtgaatttgacaattatgtgtcttggagttgctcttctcgaggagtatctttgtggcgttctctgtatttcctgaatctgaacgttggcctgccttgctagattggggaagttctcctggataatatcgtgcagagtgttttccaacttggttccattctccgcatcactttcaggtacaccaatcagacgtagatttggtcttttcacatagtcccatatttcttggaggctttgttcatttctttttattcttttttctctaaacttcccttctcgcttcatttcattcatttcatcttccattgctgataccctttcttctagttgatcgcatcggctcctgaggcttctgcattcttcacgtacttctcgagccttggttttcagctccatcagctcctttaagcacttctctgtattggttattctagttatacattcttctaaatttttttcaaagttttcaacttctttgcctttggtttgaatgccctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccagtttttctgttctgttttttccccatctttgtggttttatctacttttggtctttgatgatggtgatgtacagatgggtgttcggtgtggatgtcctttctgtttgttagttttccttctaacagacaggaccctcagctgcaggtctgttggaataccctgcagtgtgaggtgtcagtgtgcccctgctggggggtgcctcccagttaggctgctcgggggtcaggggtcagggacccacttgaggaggcagtctgcccgttctcagatctctagctacgtgctgggagaaccactgctctcttcaaagctgtcagacagggacatttaagtctgcagaggttactgctgtctttttgtttgtctgtgccctgcccgcagaggtggagcctacagaggcaggcaggcctccttgaactgtggtgggctccacccagttcgagcttcccggctgctttgtttacctaagcaagcctgggcaatggcgggcgccactcccccagcctcgctgccgccttgcagtttgatctcagactgctgtgctagcaatcagcaagattccgtgggcgtaggaccctccgagccaggtgtgggatatagtctcgtggtgcgccgtttttttaagccggtctgaaaagcgcaatattctggtgggagtgacccgattttccaggtgtgtccgtcacccctttctttgactcggaaagggaactccctgaccccttgcgcttcccaggtgaggcagtgcctcgccctgcttcggctcgtgcacggtgcgcacacccactggcctgcgcccactgtctggcactccctagtgagatgaacccggtacctcagatggaaatgcagaaatcacccgtcttctgcgtcgctcacgctgggagctgtagactggagctgttcctattcggccatcttggctcctccccctaaatccagatattttcaattgttaactgatagccctctgaaaccataagtgtgctattgtgaaatacagacttccaaatatccaatacatatttaatcataataattaactcctttcaacctccaaataatgtttatatttccctcaaaattgattattcatgttactacctcatgcaatttcatatttcatttagttacattaatattctattagttctgggccaatatacactggcaattttgttactttatgactatatctcactatgtattacctaattgcatttttccaattccaaagtaagattttaaaaaatgaatcctatgaaagctttcgtatttctccacatcctctccagcatctgttgcttcctgactttttaatgatcgccattctaactggcatgagatggtatctcattgtggtgtcgatttgcatgtctctaatgaccagtgatgatgagctttttttcatgtttgttggccgcataaatgtcttcttttgagaagtgtctgttcatatccttcacccaatttttaatggggttgtttgtttttttcttgtaaatttgtttaagttccttgtagattctggatattagttctaccatcttggaagacagtgtggcaattcctcaaggatctagaaccagaaatagcatttgacgcagcaatcccattactgggcatatacccaaaggattataaatcattctactataaagacacatgcacatgtatgtttactgcagcactactcacaatagcaaagacttggaaccaacccaaatgcccatcagtgacagactggataaagaaaatgtggcacatgtacaccatggaatactatgcagccataaaaaaggatgagttcatgtcctttgcaggaacatgaatgaagctggaaaccgtcattctcagcaaactgacacaggaacagaaaaccaaacaccgcatgttctcactcataagtgggagttgaacaatgagaacacatggacacagggaggggaacataccggggcctgttagggggtggggggctaggggagggatagcattaggagaaatacctaatatagatgatgggttgatgggtgcagcaaaccaccatggcaagtgtatacctatgtaacaaacctgcacgttctgcacatgtatcccagaacttaacaatataattttaaaaagaatcatattgttgatatctatgaaataattgattacttagataatcatctggcatttttattcatgctgggcctcctgggcctgctagcacagaccatttttttccataatgcaaccctcaattaattgatgtggtcaatatcagtgatttaattcaataaaatgaccattatctctcttcttacatgatgccccatgatcaggggttgtgatctgttcacttttatcaagttgtttagatgtataaacacagctagaaattgcattttcaatatcttaccaatttggttatatttgctataataaatattacagtaataatttactgtaataattactgtttcatttatctcacaataattatttaatattacataatatctaaatataataaaatataacatttgtgatagttttaaatatttacataaaattagctggaacggtattatttgaatgcaactggcctaaaattaatcacttgcaatcttagctgtaaataaggccaagggttgagaaaacactataaaaataatcatttgacttggtctttataccatttgtactttctgactttcaacatattctcttctggctttttcccaaaccacattaataatactgttccttgctaatgttcattttttaaattaatatttcttattccctcttgataccacataggcttatcttacttgggtgcactgtgtgatttgtaacatagttcactattttttttttcatcttgatatcctctcctcctttgacatttggaacaccacacttgttttcactctacctcatacaaactctttatcattctcttttattgttgcagtattagttatccattgctacataataatattaccacacacttagcaacttaaaacagcacacaattgttatctcagagtttctgtgggtcaggagtctgagcacagcttagctgtgccttctactttatgatctcaaaaagctgtactcaagatgttggccagatctatcgtctcatctgaggcttcactggaggatttgcttccaagctcacgtgattatgggtagaattcagttctctacagtatgtgaaactcatgttctcagtttttttgctggtcagagactgccctcaatttttggctatgtaggccagaaattctcccagtctgaaaactttttcaaatccaggaagagtctcttagcaagattgggaattacaattttatgtaacaatcttgtgtaatgtaatcatatgcatccagtcacctttggttggaagcaagtcacaggacttgcccatactcaaggggagagtagtacccaaggacatgaataccagaaggcaaggaccacagaattcaccttaaaaactgtctgccacagtatcctattattttaccatttcctacattgcaattcgtccccaatactttgtttttaccttttctttttgcagccaagaccagactaaaaagtcaattgcctgttggatattccatggatacttcgaacaaaatatatccacaatcaactccatcatttttcaacctttttcttcccctacaagcctgacatttatttgtttgtcttacttatctcagagaatgtaatgtccagctacccagttaaatgcaaccagagccttctttgtctcttttctctatatctaacatctttagatccccaccacttccgtctttcatgaatttatttaataactcctaatgtgaaattattaccacacgcagatggtacaattgtatatttagattgcctatgaaaatcaactaaaaacactacaaaaatatgtgaattcagtaatatagctgcataatagaattacatgtagattccagtagattttctgtatacaaaaataaacaggtgggagatctaatagaagaatagtccccaattataatggcaacaaaaattaaaactaaattgacatataatgtaagacttatatgaagaaaactataaaattcaggtgaagggcaaacaccccgaacaaaagaaagcctgtgttcttaggtaagaaagctctacataaaaagatctatttttcactacgtaattttacactttactataatccaagttaaacttattaagaggtttttgttgaaaacttgatccttaagttagttaacatcagttttaaaataaccgagaaaatatataaaataaaaacaaggagaaaataaatgaaaataaaatgagtctcactttgggaggctgaggtgggaagataactgagttcaagactagcctgggcaacatagcaaaaccccatctctacaaaaaaatacaaaaatcagctgggtgtgacagcacactcttgtagtctcagctactcgggaggctgaggtgggaggatcacttgagcctggtaggcagaggtcgcagtgagccaggatcatgccactgaactccaccttgagtgacagaaccagacactgtctcaaaaacaaacaaacaaacaaacaaataaataaatcaagtctaagcaattataatggtgtggtattggcccagacaattcatttaatatgtgatgaagtttgaacctttgatcatgaaaaaaaacattttgattattcaattagttgaataacatctatacaactagatgttataaattaataaatgtctatattgcatgctatgagataaaaggataattttcaaatgtatcaaaggcctaaatataaagaatgaaaccatacagtactagaataaagaatgtccgtatggccttgaaattgataaggccttcctcattgcgaccatgaatctgcacgtgttaaaggaaagactgataattgaagcaaaaataattttcaaaaatatattggatacaaataccgtaggcacagtcaaaagacaattgacaaccacatatgaaaattacactggcgtaccatttttcatctgaacggattggcaaaaatccaaaatttgatattgtagtctgtatacgagtctgtgtaaaagagacattcataaacaaatgctccttgattcacgatgggtttagttagacataaccctattgtaagtcaagaagcataatgaatgtacatcaccttcatgccatcaaaaagtcaaaaaaactcataacttgaaccatcatatgtcaggggccgtctatacattgtgggtaaagtatacattgaaacagacgtaatgggagagttgttgacaatatttagaatagtcgcaaacagttttcattatactgtcccaaccccttatcttttcacacaaaacccagcaagctgaaagctttgtttacctcacttgtataatctcccttcactccctttaagagaaattctcatttcacccttccatgcctttatagatgctattatgtctacagggaaatttgttcctctaatctcccactcttccatttacctaaatcctattcgccctttgaatctccactcaagagacatcttccccaggaatcctgcctcattgccctctctgattttctttccggttcctactttgattattctctctctgcaagctttcacaacactctatgtacaactccatcaaagaacttattaaactcttttgtaaattttgagcttcgtatcaccaatccctaacaaagtatgtgacacactggaaagtcagagctaacctaattcaacaactaacaaacattggtttttaacccctaaatgacccacattgccacaaaataatttaaaacatccatattatcaacacaaatgtttgagcagtatcataaaaatcaattcaccttcccatgtacttttggcaatgaatatgcagtcaaattataggcataatttcctactactccagtgaataaccctgcacatacctgacactaacatttaaattaaaagtttagtcagccaaagaccaccaggaacaagactgtagtcagaaaaataatcagatttattcactcagtgcaacaagggaggatatgccagaggaatattattccagaggatggaagcatccttcctaaaggttaggtttgctgaagcattatgaggggatcatttctggattggatactgtttctagggtgggatcattgataagaaatcacttaaagagaaggatgctacaacgttttacactttcgttgtgattttgggagcaacaatgattacagtaaactacatgcctggctttgtatgtgtctatcttcctggtctggttaattacaggacttttgttcttttttagtccaatatggattttcacttttccagtcctgaacatgttttcactttttcagcaatctttgaaaaccagaatgataggactatcatagcccttggaattttaaacctagctctttcatttactggtttaaaaacttttaaattttagtttagtctaatgacctcatatgtaaaatttgataagcatatttgttcaaagagctgttattttaaggattaaataatctaaaatatttaacatacataatatagtacctccatataataggtattaaatatgccatagctgacaagaggaagaggaagagtaggagtctaaaatttcaaaataactggtagtgaagacgaaacagtaatcggactcactgttgttttccaaagacgtattttttattagagtcaaagaaactgtcactgaatttgaaggggtaaaagatttgttgggatcagcagccaagtagaatagaactttgaaggtcagaactaaaagttcaaattcagtctatgagattgttgggagatacagagtaatatgcactctgggagaagtttcaaataccatcccagctggtgtgagtgatgtgtctattatatttttgtcaaatttggcaccatccacctgtctcacatcagagcattatatgaaaagaataggcttttccaaagtatcaagttgtcaaaatgtttcaatcctcttaacaaaagtgttgtatttagctccatagtacatctgtatcattgaaataaggccctttactgctaaaaagaaattatccaggaaaaatgaaaagaggaaaaggagaatgtgtatgaaaaaacttaatgataataaccacaactatccccaacctggattctacttcgtacgtttctgtctgaatgtgccacattttagtctctttaaactgatgaaaaaataatcatttccgtattcagaaacctagactcaaatatttattgaacaccctgtatgtgctggccttatgttatacgctatggataaaacagtgaattagatgttcatgctccctaccctgatggagctctgattacctggtaatcagaaaagtaatcacgtatttgcaattcactgtgataagtgctttatgagaagggaagtgaacaattaaagtgcaaaggattataggactttccggggaggatgtaaacctagacagtcgctgtagccctctctttcaactttgatccaacttcaaactagcacctatgtgtgaaagagttgctagattcagaggcaggtggacaccacaaggtgaaaaatcagccacttgttttgttgggatctgatcctacagaactggcaatggacttttcctatttgggtgagaccaaagtctgtaaccagctgcagaaagctttaggaagagacttaggacaccacaattcctagggagaacttgccatcagtatccatggatgtccaagcagaatggtgatgctggctgctgggattgtgtctggcagacctactggtctccatgaatgctgaaaagcatctcaggattgcagatgagtttatctgaattctcattgctcctgaatttagagaacatcggtctttgtaactgaataaataggcagcagagaggcttccttctgatgtttctatggggaactgacactttgtgacctagggtatttattgacagcccagatagccagcgactactcattcttcaccgttctgcttgaagtaccctagacatcaaacgctacccccaaggatgaatggagccaagagaaaagacaaataacaaaaccaataagagattctgaaaccggggagagagaaaaaaaaaagtaggacagccaagacaggaggtaggcaagtaggcatagattaatagtttaaagaacttttatttgcaacatataattctgaaaccaaaacaagcaaaaaccagaaaaaggtttttaaacttaacaattcagcaaagaatttttaactgagaagagcttcattattgataaatgaattagtgaactgaaaagtcaagataaactatatttcaaaatacagatataataaaaaacaggtggtaatttcaggagaaaaaaatagcagcgctacgtattggatctgaagatccaagatacaaatgtaaagagttccagaatgagagagcagggatattagagaagaggggaagattaaccaaataataacagaatattcccctaaacaaataataacagaatagtcccctaaggttaaaaaaaagacttcagtctgaatattgaatatattcatttaagcctatttaggcttgatgagaaatgatccttaggcatatcctgataaaatttctgtactccaagataaagagaagaaccttacaaaatctgaaagagggtgaaaaacggaaaggtatatacaaaggaaaagaatcaggcattagatacttgaaactagaggagcaatctataagctaatgagagaaaagatacaatttttaaattctgaacccaaagaaatagctcacctgtcaaaatattttttaaaatgaagagaatatagcatacacattttatgaagaaaattaccatctaaccaaataattattgaatcaaacagaaaatgtaagacagaaaaagataaatagaagaggaaataagagaaaatctaaattttttcactcattttgactctatacatttataatacatgatatataatatatgatacataatatatacagccatgcacatatgaatataaataatgcatgatacagtgactattagtgaacaatatggaatatttaaattaaagaatcataatgcagaaaatacaagtaatagtgtagattaaaaatgtttaattaataaacccaaacctagagttagaagagaaggctagtaaaagtaaaaggtctttaatgacacttggtacagatatgtttatttcagcactatttataaaatgaaaacagaactaatgattttaataaatcatagtacagacaccatgaacattatgtgaccattaaaaataataaatagaaggtatcccaattgttttggatagatttacaacatttgttgtttaatgaaaagacaatgtgcagagttgcatatataaaataaatcccttatatgtttgagtatgtgtgtacacccatgtacataattacatgagcattgagaagaatttgaaattataaacactggtctgttaatattggttaccctcttgtggggagtagcaggaagaaagaagagagagcacaaaaaaaaaaccagtgaaagaaagataattgtttttaacagtgtccttgttaaaaaagaaattatgtattatgtaatctcagttataggtgtgtaatatatgatgtatatgcacaaagagatatatggaatgatggttaaggatggttattaaaactttaattgaagtttccttgaggtagtaagtttcagaaagtatatatttttctatatttacacacatatatatacaaagatttgtaaatataaggctatcatcataattacaaattcacaaaggaatattgacattatcataattgttccttattgaacacaaacaaatgtcagtaactagactcacaactttatatataacatatttaattctacaaaattttttaattctaaaaatgtattattgtcacatgacagttgaggaatctgagtttaaagaaggttgtatttcttacaaaggtgatagagatagtgagaaaaattcagatctaactgcctcaaaatactttcttttgaatactactcagtactttcctctttctgtccccctactccaacccatcgctgtgcctactctcctaggcacactttcttcctttcactaaaaaatatttttaaaggtgtttgatgccaaaagattattctcttcgctggatttgtgcactaacacctctcagttctgcttcctgggcattactggacctgctaattgtaactatgactaagctattaccttcacatgttgtttccattttcgagggcatttcactattttttctttatgtattatagatattagaaataattagtttagaaagtgtcagtgtgtgtgaataaacttaataaagccataattttttctcacttttagtgagtcacataagctgaaacttccttctttttttttttctttaaaacattagctgagggccgggtgcggtggctcacacctataatcccagcactttgggaggccaaggtgggcggatcacttgaggtcaggagttggagaccagcgtagccaacatggtgaaaccccatctcttctaaaattacaaaacttagctgagcgtggtggcgggagcctgtaatcccagctactccggaggctgaggcaggagaatcgcttgagcctgggagatggagggttgcagtgagccgggatggagccactgcactccagcctgggcgacagagtgagactcgatcccccaaaaaataaattaataataaataaataaataaaacagttgaaatcaagacagtgcttcaataggcacctccttcttatgtatctaatatttctaaacaggttgagaaattgccttactgggtggggatgtttccaatattcttactcttatttgtcaaccttatagttttagccttcagttatcaaccaggatttttaaaaattatttttttctttaaaactttggtttaaatcaggacagtgcttcaaaaggcactaaactcttctccaaaaaaagatcatttaataattactcatatttattgattgctcaccatgtttgatgttatttcaagatagattttcatggtgatttcgacttcaactgaagcagtaagacctttacaaaaacctggtatggaacatcattttctctcttaaactaaatgagacagtaattgcttttatttatttggtttgctaccagtaagatccattaatagagaatacgtattacatttacaagatactggaggttctttgtttaaaccacttcattgaggtaaactaaaatacaaaagctgcacaaatttaatgtatacaatttgagttcagaaataagtatatatgcatgaaaccatcaccacaatctatgtcataaacctgtccatcactttcaaaagtttcctcctgccctcttatttgttcttattattatggtgatacaaacacaatataagatgtactcaattagcaaatttttaagtatacaatacagtatttttaatggtagacactatgctgtacagtagatctctaagacctagtcatcttgtattgtctaaactttgtaccctttgactaatacctccctattttctcatcctcccagcacctgacaaccaccattctattctgtgcttaactgacttgtatagaaatgtacgaccttagagaatttatgctgttggtagttgatacattctctgtcctcactgaagattattatcattagaaagtttaattacaaatttcctacactttctaaatatttgctttaatgaattgaaaacattttaaacaaaattcagtgtctgaatttaaaaaatacatgtgtgtctagaagcacaaatacctcatgatctcacttatatgaggaatctggaaaagttgaactcatagaaattgagagtcgaatagtggttatcaagggctgggggacaggagaaggatgaggaaaggggagatgtcagttaaagggtacaaagttttagttagacagaagtaatgagctttagtgacctattgcagagaatggtgactataattgctagtaatgtttcgcatatttcaaaattactaaaggtagatcttaaatgttctcactataaaaaataatgaatatgtcaggtgatggatatggtaactagcttgatttaagcattttggaatgtaaatatatatcaaaacatcatattataacccacacatatatgcaattattatttgtcaattaaaagtaaaataaatttttaaaaatacatgtgggcttattttgtgagaaacccaggggagagatgtaaactctgcttcagtcctatctcagctgttctcctaagaggaccaagtctggtgttcaaattttttaaacttattttgtattatttaacttattgttttaacttgttgtttaacttattcttttaacttattttgtattaccattttcatcttcatcactctttccctgagcactagcctttcagggctcccagtatttatttatggcgaaagtttggggacagtaataactcaggtataaattggataataagaaaataaaacagtgactactagcccataatgttgaacatacacaacacttatagaatcttaaaaaacctcaaataaagccactcagtgaccttatctggaataagataaaggagacaagcgcactctgcaaacgcaaaaggaactagacatctcctttttgtgacagacatgactgactgctacttttttttttaaccaatgttagctgcagtccagctttaaacctctcatctcctagaaatatatcatatacttgtatatgatatccaatgactcaactatccctgttaatgacatcatatccagaataggacgctgatctcttgaaccctcctgagcgcaaagcacaagctctaatcctgtaaggagttcctcccaagtcctatttctgaaggactcctcggatttcctgcaatatggtccaattggctgcagcaagcatgataaacctcatctcatttttctacaggtgtgttcctggtgatatgtggtcagtaagtatcttttatatattattttattatttctttaccttagagcatgtttactgaaaggtagaaggaaaatgtagcttatatccactgctgtgaagtattgtggcaaactgtgcataagcattcccattaacaaatacattaagctaaatatttaaagagtagatgttataccagatctttattatgaagatatcctttatggactttattagagaaattggttagggtgtcagaataggctgagcacacatgtttctcatttaaaatacaaacccaggctgtctaaatttacactatccaaacatctacaggaaaagattaggatcagatattttattggagccccctgagtgggacactggagagggaaaacaacataatgtgatacgatttttggcattttcttcacttttagtacctgcagttgaatcatatgtgttacaaacacaaagagaaatatgctatcttactaatcacagtgttctgaatggacaattatttagatggatcatgagtgaaaggcggattggagtagagaagcaatattttgatgttgcacttatgtgtcagaaactataaagacactgtctcattcaggtcatgtaaaatctgagaaagaaagcatcactatcccgtttcacggtaagaagtagtaaggagcttctcagattcagaagttcttgtacctgccattgcacagttagcttattaagggcttacaacctctccagtgtttcagattgtggctggaatgtaaaccaaaggtgttggaagtatgagcactttcagggttgaaccttaaaccttgaagtctaagaataatgctcttaaaacaagataaaagtgaaaaaagggagtactttgtgaaaattacatgtgaggatgactaaaataaatatgctaaaatgtaattaggagaaagaagtggctcagtttcagttatttgttaccatttttttccctcatgttttatctgtatgtaagacagcattcctttttggcataaagtattttaatgcaaagttaacaatttggtcacaaactagttttacaaactagtaatttgtacttctctatttcctatctcagaattctgatttcctatctaagaattcttctctttcttgaattactggcatcagagatacccttgcatattagagggatatgttcctacccaaaaaggtggaatagtgccttgaatatcccagcagaaatatcacaatgtcgagacaattagtaggcatgatacacgcaatattcatgtaagagatacatgcagggaggagctactggtttttcattaagttctgtgcttccagctggcccaacactcacagctatcactccccagatcccatcacatcataagtcacagctcctctatctctgcatttacctaactcctatttctaatgaataagctcttagcctttaatatgcctcccgctgtttttgctgctgctctaaaaatatgcctttcttctgtctctgtcgctttgtattcaacacatttgtaaatttacattatactgctgagtgggagacgtttttgtctactttcaatactacaggtcttttatcttttgatctttgcccatagagctgtgacactgggctaaatcctgttattccagtatacactgaaattcagtgcttgtatgtgtcaactacattaggctagattatgctacagtaagaaaaactccttcctcgttgcagaaaacaacaaatatttatttctcacttttgctacattgcctgctacattattttgttacatacttgcgacatgttttgctatatttctgttggcccggaggctctgtctgtgactaaataacccaaggtgatggtttagtcatattttcagatgtgatcagttactgtaacatggggaatatgacatatcttacttcctctcacataccattggccaaaattaccccaccaatcaaatggagcagagcaatgcaatcctaccttgttctgtgaggcagagagctggaaatagttggcaaatggcattaatggctactacatgaagcatgcataaagggaaacattaacacatttaaatggcctactgttgtctttttcatgaaagtgttctattgggtcccagtaagaaaagaattaatattgaccgaatactatgttccatgccttgtgcttggttcattctttcagatcttagtaaatttaatatcattccatcagaataaattatctcaaaaatcagagagaaatacactcaatattatagaagtagcaaaaatgtatgcaaagcccacagtgtcttcaagcttccacttgattcttgtattgcaagtatagtcccattctccattatccccgctgtcttggtttgcctgtttctcctctgacatctttctttaatccttaacaataaatcccccaatggcagcaattgggccactttgccccctaattagtcttatttatgggagtatcaggatgagattcaaggaaccatagactagtcattaagtggctcaatatcaaacagtccatgatattatattgaccatttccttctctttcagggccgttgctttatttttaaattaaagttatgtcatttattctttctggctattttgtgtctaattattctctgtacttaaatccctgtttgggtgtttctaattgtctcaatctctttaaaataggagacatttatttcacagccccagtccccatgccccaaccctgcttttcaggatgctgactgcccaaatgctctgccctgttactactgtcctcactcctggttctattcctgttggttcctttgctctcaaatcctgaaggtccctagactgctttgttcactaatggcaacaggaaatatttccaaacacagaaatctatgcaggatcagcagggagttctatgtcactattaggtgactaattgctccacaaatgatcattatcatgcaagttcataaaataacaagccatcacatgtttctccattgacctattaatgtgataaattataattattgcttatagaacattaagccagcctagcatttaagtaaatcttgtgtgtttatgttttgattatttaattcattgtagtactcagtttgtgagttttcccctcttcagctttcccctacgtaaattgaaaataatatatttttctttctgtgatctctgtgaaatttagagtgcttttgcccagtgtctacatagaaagagaaaagctgggcagaaaaagcaaatggaatagaatgagctcacgaagtggctcttgctctgatttctctggcttgaggaaacagagagagcaggaaaggaagtgcactaaagggaccaggactttgaaaatttctcctaaaaatcagccagaaagaaaaacaccatgcgctagcagtggcaaatagtatgtccttaaacccaacacattgtcgaatttcttataaagtttaggaacagagtaaagagaaaggtaaaggaagagttttggatgccccttaaactttatctccatacagtcatctaggaaagtaggtgcacttcagaccccagaatattgtaaagccatgaatatcacactacagtcacatcttagaggtccatgtctgctagctgttttaagccttagcactccaagggaatgaatttcgaattgatttctcaggactcaattggatagcagaagtattagtagctttctcactgtcgtgattctacactgtacaagttacttgggttaactgctgaaagagtaaatacaaaatgtttaatggctcagacaaaatatgtgtttatttctgtttatgtaaaaaatccaggacagttcaatataatcttcccaaattttctacttgaaaattgaatgggttttcttgttgtcttgggcaatgaccaatagcatgttctaatttcagtctgcaccgtattaataactttctacgctctaacatggacagattgagaacttattcccagagactccaaacaccaactccactatttttggtatcagggacatggtactttggaaaatgttggtgaagttaataacagttttaaaggatatgacttctctctgcctcagcacatgggcatttgtcagactttaatagtattgcaatataatggtaagtatataaaatattatacaatatataatttatatgctatctatttgttggaatttatagattagatttcactgggtaaatgagacagaaatactctgtaggaataaaaatatgtgctgtatcactggggttagctcaaatggggcataaagaatgagtgatttttcatttattattggattagtgagactaaataagctggagaactcagccgcatttgagtacatgcatactcattttacctgattgctctcttcccataagtaagagaggtttgatacagaaataactggaaattgtactggcatgttattttgcaagcaatatcctattgatgtgggctgatgtaaggaagaaagaatagcacagaagtgtgaaggtgactcataacgccatgttcatattattttctataaataagaaagatagcatgcatcatcatcagtacagctgaaggaatcagctttttaccctagtgccaagctatattatttcacatttatactattgttatgaatatgaacagtgaaggctccagtggagagtcaaaatgattttgaggatatgcactttctcctatacaagacattccatttttcttcctttaatagctgtttatgctaaaatacaaaatgcagcctgataaatatctaacctactaaaatataattccactttgcagaaagatttggatggtgctacttatttttaatattctatttccttcaggaatgaaaagaaatgctggtattgcataatgtttcatttcctattatacatattcagggaatttatcatctcgccataaatataaaacttaagcaacaaaatagaatgactgaagaccttgcatttttaaatctcttctttaattttctgggattgaggtggcatcacaacttggcgacctgccattagagcaagacttttgtcagcaagaatccttgtttaggattacgttgaacaatgaacatgcagattataggtaaagacaggaagaatgatgcttcccctgtattttcccttttctttaacctttaggaaatattttcttttcttgccttggctgttgtcattgcctcttggagtccttactttcatctgaccaaattatttcactgtgtttttcatacagcaactggggcaaagttgaaaaaagaagaaaaataggcaacaactgcttaaaatgtttgaattgctttccactctactctgaaaaaaatatataattcttctcattttggcctgaaaaggacaagttcttccatccattctctccaactttttccagcagtattttttccatcactcattatttaggtgaccatacattccaacttatctatatttactatcccaatttacttttgctgtacaataattccttccagtttattatatgccctgttgataatttattatgataatatttgttttgatactccaactgtccctcattcatcccacagaagactggcttctgtgtcctcttgaaaagtcccaactattttatgagcacttccttgctatttattcagtctgttacaaagtacttttattaatagtcatatggaaatagttcagtacctatttggttatccttccattgtactttcttcttctgccattatcttatctcatctagtactatgtgacatacacgtgcagttaaaatagtcttcacatcacatgtggttaaatctgacaaaaaaaaaaaaaaaaaaaaaaaccagcaggatcctgtctcttttcctgattcttttagtttcaaaatcacttagacttcccttttcagagcagcatgcacggctcccaccgacaacatgaagggaacttagattaaactgggtagtagtaacagctaattgcttgccatttacagttgtggtgggagacagattgttttttgaaacttatttttatttttttatttctttaatgaagcctaatttatttatttactttatttaatttttgtttttattttaagttccagggtacatgtacaggatgtgcaggttaacatggtggcactgcctaccatttggattctttgttccatgttgtggcttgagcaccaggcagccatttggcatttcaataggaaacttgaaaattattggttaagtatatgtaaattatgtgtagaaattagagatttagcaatcttgctatagagcctataaaagatagtcagaatattattgctatattgattttgtaatttactgtatgtgataaatgtacaattattcactttgtttgacaatgttctttttaaattttttttgcagtaaacccttcagacagcaatgtgttgaaaaagaagaagaaagaaagctttcttaaaaattttctcactgatattccatttcttaagagttgattttgtgcatgagtaattagcacaaaatgctcgtagacaataaatatctatgtggataatatcactaagcatatgcaatcaaggcacagtcttttgaagaacatcattttgagaagacagtgcctaaagatgacgatttaatatgtacagttgcagaggtatgatgaagtaacactaaaagtgacttttttttagactaaataactgctgatctaaatgaatttcactaatttcaattgtcacttttcttgggcatgtacattaaaaattgctgttaatgtgttggcttcattagcaaaagaaattcatgagtagttaaagaatgacagttttatattatcatcttcagatacttcaaaaggaaatttcattaatttacaaccaataatggttcaattttgtcatccaattaataaaatcaaagtaaaacctttgcaagttcaatctgtcaaaggtgaaacatctgaccttatgaatggtcttatacattcaatttaaggtttaatattgcatatagaattactactggagaacacaaatgtaatggagcactctgttgtggtgaaaacaatgtgtttaaattaagaaatctactaaacacaaataaatcatggtacagacataatttatatttgataaatccaaataaaaactctacatgtcaaaatttacatatgtagtaaccaaattagaaaacgagacgaagttaatgttgattacaacataaatcttcaatttggctgtatatatcttctttctttgctgtctgtcttcaattggattttagaaatgtttgatctgctgaaaaactattttgtaaattgtcctgtgctttatagttttattcaactttttaaacaaacaattcctcttatattttggtttcgtatggttcatatttagttttaaattgttatttaaaaagttaattttaagcagagccataattcatcatcttttcaagattttattgaatagcaatcacaggaaacaagattttcaaaccagtaaactttaataaccatctcgagagaagttagtgaaaaatttaaaatgttaagaaatgacaagtcaagagtgtagaagatttaattttaacacttgataattatactttggaaatattttgcctttattataaggatcttttgatggagcttcttttttgtacaaatttacgggttacatgtgcaattttgttacatgtatagatggtatagtggtcaattcagggtttataggttacccatcccgtgaataatatatattgtgcccattagccaattttttgtcatccattcccctcccaatccctcacctttctgagtgtccaatgtctatcattccagcgtgttcatgtgtacacattatttagctctcatttacacatgagaacatgtgatatttgactttctgcttccgagttacttcacttatgacaatggcctctagttccatccctgatgctgcaaaagacataatttcattctcttttatggtagaatagtatgccattgtggaaatataccacattttctttatccattcctccatcgatggacacttaggttgattccatatctttgccattgtaaatagtgctgcaataaacatacttgtgcaggtattgtactgatctcttttcctttggatagataactgtatgggattgctgggctgaaaggtagttctatttttcgttctttgagaaatctccgtactgttctccatagaggttgtactatttaccttcccaccaatcgtgtataagagttcctttttatttgcaaattcgccaatgtctgttatgttttgttattttaaaataatagccagtttgacttgtgtaaaatgatacctcattgtggttttattttgcatttctatgatgattcgtggtattaagcattttttcataaacctgttggccatttttatgtcttcttttgtcttttttacaacagtttcctttcactaaaaagtgcccacttttaatgggattatctcttttttgctgtggcgttgtttgagctccttgtaaattctggatattcatcttctgtcagatgtataatttaaaaatatttttctctctttctacaggttgtcttttcgctctgttgattaatattttctgcttttcagaagctttttagtgtaattaagtcccatttttctacttttatttttgttgcttgtgcttttgaagtcttagtcacaagttcttttcctagcccaatgtccagaaaatgttttcctgttgtcttttctagtacttgtataattttgagtcttatgtttgtctttaattccatcttgagctaatattttagtatggtgagagatagatatccagtttcattcttctgtatacgtcaatccaatttatccagtactatttattgaaaaaggtgtcctttctccaatgtatgttcttgtcagcttttgtaaaagattgattgtttttaaatatgtggctgtatttctgggttctgtattttgttccattgttctatatatctagttttgcctccaagttagcctggtctccaggtctatgtttctcaccattatccatcaccttgtcttgacagagccacaagttaggaaaatacgttgaaagaatagggagctttattttgtatagcttttttattctcagctgtgggctcaatttagtctcctaagcaaagggtaggtcctgacatgtgtttcttaattaaaatttacatccattattaattttccctgtggcaagtagcttacattgtattttgtgatatgactctccagtaggcagaagactttgcttttaatgtttataatatcacattattgtctacgtgataatacacaagccacttaacatatctacatgtaatatggacatttggtgagcagataaaataatatatgtgaacatcttttaaaaatgtaaagcagaaacttttgtgtggctgcattagatgtaatatctaatactatattgtttttggtctgacagttaccaaaaaatctcatctcagaattttgactatcaggtaaatgtgtaccctttagatcctgccttcccattctctttatgagcaaagagaactatgctttcacagactactggtgtttgaaagtggagcactgcagtattctgttgttttaataatgcctatcttgcctgaagcactaagaaaacaatttgaatctcctagtcaagtgtgtgtgttttctatcaatatgtagttatcatgccaccaagtgttgtagttctgaatggcagtgctctcacagtgagctttaaatcagttaattactacatttgctttttttggcgggggaaaaattaccttcatgctaccacaattctgttttcttgaatgtttttgatattgctttaattacatatacattgaatgagtgctcatatgttaataaaggagtatttgctaatgtgttgaatgtggttctagaagtataatttctttagcactttgataatacagcacaaaagataataaggaaaatagtctaagttatcccccacaagtctacagtaggactgaccgcagtgttattaagattttcaggagttttcctggctatcaatcaaagcttctaaaagtcatccctgtgtttatatttttaccatataaagacttcctactactatccttttgtaagtctatgtaagtatgagcatgagttactaaatcatccaatcagctatttgaatagaggaaggattttacctaaaagcaataatttttctcttttgaaaatgtaaggaaatcaagcataaaagtaaagaaagggatggaacaaaagaggaaaatgaggtagtaggactgtactaataatcagagtagctaacaaaaggtcaaagggtcatggccaagagaaataatttctaagacaacgataaagtgataacattaacatctatacgaatagagatgtgttctcctaaatagagtcctttatcagaaacaaaggaagcaatgtgataacgaaacagaacagccaagcaacagaatgacattaaattccaattgagatagtataccttttgctgaacatatgggatacattcttgggaatctagcgactgaaacatagcatttatagtcaataaggaagtactcaaccaatgcaagaaataaccaaataatagatagcttccacaaatatggtgctataagtgttgttgctcaataaatatttattgagtgagtgaatgaattaacggttaatgaaggaaatactcttcattttcaacattgattccctaattaaggctttcatctccttcacacctaaaattcagtcatttctacataaccatcacaacaaatatgatggttattatttgactgaatattattgtgatttaagaaaacaaaatcaatgtttcaatagttattgattgctatttaaccaaccatctctaaatctgttgaaacactaatcttaaaaaatatattatttttcaccaagtgcctctgtgttaattgggttcagcatagtggtctttgcttgggacctcacatgtgctaccagataggggctgggcctggatactgttggctacagtatctacatgctacatacaatttctccacaaggctcaggctattcacagcatggttattgggttcttagagacatcatccacaaacaaacattccgagagacaaaaagtagaagaacatctgtgtctgtaaattggcacgtcataatgtctgtgatattctgttgctcaaagcactcaaagaacctgcccagattgaaggggagaaaagatagggtctaactcttgaagaggagaaggaatcacaaaaaatagagccatcttaatttatctaaatcaacaatacaaatactaataatagacatattttacgacgagtatgagaatgatgaggatgagatgagttgtgtatttcttactaatccttacatcttcacataaccccatatcctgattttttgcatgaggaaactgaggatgaaaatagttatgtaacttggtgaaggtcacaacttggtgagggctcaaacttaaatatgctttttccattttatttcattatcttctcaccctaccacaaaatctactataattccctgtgatctcccacaccaaagctaaattcctttgtataatttcatcaataatctttcctattcctgcttatgcaatcttacatgtttctgcatcccacggtgtaccctcattccattaatgcccagctattaacccatatatattgtcccaactttgccttgttccccttacctgaaatgccctcatcgcttcccaccacctccaatctaaattctaccagccattcatacatttctcatagcccatcatttttttttttctctgaacgtctccgtatctatctatagcagcccatagttatgtcccattttagtgtatcagctgttggacctccattgttggtgttttcacatgttagttttatcattccaattgtattgcacattttgtggctgtatctatatcaccacatctggtattctttctgaattccttgtagcctccatcctctaagactggttcatcggagaattggcaataaacttcaacatggtgctttagtcacactaaagtcaattgaaaccttccatacaaaaatgatcaatgaaaatattagtctgaagtaactagcttgaccatagtgaagtgaagcatagtatgcagatgatacacttatgcacattttgcactatgttcatccttgagccttctcagcaaattagagggaaaacctacaggtcaaagtggcccagcaaagctgcagagttattgactacatgctgtgatttctgaatttctattaaagagcattttctcttctactaggtggaaatggaaatggctttaataagataatgtattccacaattcagaatgaagcttaaggcatgtgttcactaaaagcatatgatcttttccatagaaggttctgatctgtcttatgaagagtagagggattaagaagttcttgggcatattgtagggaagtaggtatttcaagaaaggaaaaaggatacctgttaatagtttgcctaaggtggcatttgctaatgtttctaacttcaaaaaagagaaaagaggacatcctagggcataagtcctccggctgtcaaatagagaggttggcctgatagcctacggagtccctaccatcagacactcccatcccaatatccttcatacatacatgtaaccactcattgcaggttggagattatttaaatgctggcttgaaatgttgctgagcattaggaggaggataaagtggggcaatattttacagcatcctgcaccactttccttatcccatacaattactaactattttcctgagacaaatttccaagtcaaattgtaaatcagccatgagtcttacacaacaaaatgaactgatcaagctctccatagtgtcaagtcctcaggtagagattttagaaagtagtttaggaggcaggctaaagaatatagccagccagcttgtcttaccattaactttatttccctttctatcagggacaggtaatcttgtttagctggccacttagtcttaataagccaacatgaaagctctaatgggaatgctaaaaatctcatttataagagtcagatgatttctggttactagcggcacaattttctatctccagttgaccaggtatttgacgtctactggtgtgagaaaaatgactttataatggggaactgaacaaatgtttgagttttattttgtcttgagggtaattattactagagttctcttgcccttgttttgcctctcacactaaaaacaatatttcaaaactgaaatatgtgccatggagtaaggcatgtggttgtgcaaagaaaattgtaaggtttgaaaatagtctttcttggcatccctgtctattccaaatctaaaataattttagaataaattggagcactctgaatatttataaatgatttaaggaatccagtatatctagtttctccaagaaaagtcatgtcaatgatccttggaaattctttatgtttatccctgtcctgcaacatggcagggaatgggatgctccatgaagcttccaaccttatatcatgttgctccttgtctaatttagagcaccgagaagggcatgatacattgcttttgctactctagcctcagcggtggaacatcgaaccctgacatggatgttctctatagtagaccctgtcccttccctgtgttttggccacatcctatccctgctactctgagcctttggcttgaagagagcaggaatgactgcaaatttggtctccgcactctgttcaatgaggaggtggagagagtgactgctattgcagcatgtgcagcagatgcatctgcctaaatccatatgcagtagtcacagggagaaaacattgtgggctcttttttctggcaaaggaggcaaaaaggcccaacgtgtctcccaccacacctacaaacagagctgggcagcagctgagacagccgtagccacagttaggaaggagtgaattaattattctcttcctcacttatattagatgttgaagcagttgcccataagaagcagctcttttcagcacttgtgccgtacattcctactcatttttcatgcattctagagcatatgggttgtgtaattggatggttcacccaatcccatcaccatctgctctccagataagctgcacaagcctttggtaaagtaatgaaagatttgactgtccaaaagcctcttctcccaagcaaaactttatactttcaaaataagtatattatcataatgaattctgtccatatatgtccatataaattttgttattacttcacatgtaaaaaaaacccacaaaataattttgttgaattgaatctatactgttaccaagtatacagaaataataattgtattaattttaaaataaagttgccttcaaaatggtaccacagattcacattttaaatagatttgtctatgtggaaatttctctacatatcagtcacatcaacagtcttctcaaaaaatatgaaaatgaattaatttgcatgtttttgccaaaaaaataatctcacaaacttcaatttgacttgtgaggtgttgatttcaagatgtgccaggatttgaagtggattctagtcataatacaactaggttgcagttacacttctctgtgattctatgctctctcctccttcttgatttgtctttattttcagactgtttataagatggattgagcattttccagcatcacatccagacatgacaaatccagaagacaaagaatctgtattcctatgactctttcatggaattgagaaaatgtctctttaaagttcctcagatttttttcttatattattcaccagaattggttgaatatccatttctatactaatcatgagcaagcaaaataaggttttcatgattagcttacatcagtccttggaaagtcaagcatcaagaatatttatagttatccattaaatacacacaaaggcttccaataatctgtttactttgatatcttcctgccatctagtggattatgcatctggcttatactggggaaatgtaggaaattttaggttttccagccatatttacatgccaaagtggtctagatgcttactcttaacttctttaaatagttcaaaaaattacactcaaggttatcttcgcatagaaacaccaattctagcatttgttgaaattgttcagatggaaatataaaaacaaaatgatgtagccagactaactttaagaagtatcacttctgatgtgtgttcctgcaatgattgcacttattgacaggtgttatttgtgtttgaaatctccttgtacttattcttcttcaagtgagatattgaagaaataaaacaaagaggctgggaaccacatttaatgccaatcggaaatgcacatgtaaaacaacaacaaaaatgttccttattccttatctgagtctagaaagacgaatggataaaatgcagtatacccagaataaatctcaaagaagacaatattaaatatgaatatggattcagtttccccaaagggaaacctatgtatggcaggaaaaccagtgattatgatgtctagtgcacattcccaagatgacaaaattgacttcttagtaactttcgtttgaagaggctggtcaggcatttatccatttttgctaaacctagactatgttttgaaattataaaaacagagaatttaacagtgaaaaatcatagaactgttattttcaagttatatcaagaaactgattcagtcttaaaatgaaattgcttaatctactcatgtttttttgcataagaattcagtagtcttagaacattttctaagagtaagttttacctttccattcttcaagttttggactttggtgccaataagtcaatcctatcatcatttgtgctctgtttctaagacttttaggacctctggaatatttccagtttaaaagtgagcagaataaaatagcagaatgagccacgaattttggaaacaatggaacttgagaaagctctggagccttgaaaagctaagcaggaaacgacattttaagagtcttggccaggcacggtggctcatgcctgtaattccagcactttaggaggttgaggcaggtggatcacttggagtcagaagtttgagaccagcccggccaacatggtgaaacactgtctctactaaaaatacaaaaattagccaggcatggtggtgtgcgtctgttatcccagctgcttgggaggctgaggcaggagaatcacttgaacctgggaagtggaggttgcagtgaaccaagatcatgccaccgcactccagcctgggcaacagagtgagactccgtcttaaaaaacaacaacaacaaagaatcttaactactttatatttaagagacatattgccaataaataaacaaatgaggactcttgcaaaatgcacaagagagtaggattattaaaccatattttattttatgttttaattttcttcttgatgttttcaacccacaatgtttaatgtgaggcattaaaatgttatggttagttcagaatcatattaacatttaaatactgtatgtatgtagtctaaaatgtattcttggaagtattatgtatttaaaacctttttatataattcaaactgatattcaatgcaataaatatagatggcactcagttatcaatccttttaaatatatctttaccattttgaaggaggtggttttgcaacattttctgtacttttgcgcttgtgttctgctttaatctcctatttatactgatttcaaaatagatccatttaactgttggctacaatgcacaaatagtcaagattaaacctcactatggtttgttgagtgcagcaaaagatagcaagtctcattttgctgaggagattctggctctattcaaaagacaaaaaggaaaagtaataatgtaggattaagcagattttaatttcccttgtttcgacctttgactcttttaccttttgtattgtctcttttctgttttgccccttttgctacctccttctctcctgaatgttgaaaaactgtaaggcttgcaaaaacagctatgaaaataacttttctgacaattgccaggaggagattgaatcaaggatcctgagcaaaaggcataaaaaaatcattccaaactagagttttccagtagttaaaaaagaaaactgcatcctgtcttgcaccgttttcttctccaggctctataaaactccagtacagactcaaagtccttttctgtcttatgactttactaaaaatttactgctcttcattgaagatgctatataagctgaaactcaaagcttttaggaagagggaaggcagagagctttcctccattttcttcttcttaattgtcttcagttgaacaatcctccatattttgaacaggcatattctggtgtcccacagcacaaaagtggcatgataattcctaactctagttttcaatcttggggtatgtgtacttcataatatatctgagaatctttaacaaaagtaaacctgatttttttcatgttaaatttaagaaatattgatttatatactatgtttctaccatactaaagaggagacctcttctctaatataattacagaaccaaagagtattccaactccaaaacattttttggttttagtcactggaagttctcacttctcagattggcaaatgacttcttctgagcttctaaacagtatccccaaaatgaagccaatgtaagcagccacaagtctgctgggcaaaacaacagcagcagcagcaacaacaacaacaacaaaaacaaaaacaacaacaaaataggcattatctttcagctttcagtccttttactggtgcttggtgttatataaaatatggctttccactgctattgtaatcaacaagtcaacagctttgactttcactgcacagacattgcggcttgagcattccttgctacccaataggaatttgtttgctgatgtcctaggaacaggacagaggcaactatttcatccaggctttggtcaggaaactaaagagggagtataattttgccaagaaatctacagttatcactcaatttattatagtgttgctctctgaggaatggcaggataaaatacatctgggaaaagcaaaagacagtttaatacaaagggagcccagaaggtttcagatcattccattaaatcagggctagacgagggccttagcatgaacactgacttccaaagaggatgaataataaaaacaactaaactttatggagcacttactatgtgccagacagcaatttatatgagataggttgtatttattttttaagaggtgaataaactgaggaaagaatgcaaggtcacaaatctaggaagtctttgagccagaacttagacctagatgttctttcccttcagaaaccgtgattagatgtattattccacattatctctcgagaatacttgaaaaggctttctgtttttatttgaagctgtatgtttcacgtgtgtcagtcagaagactctgtgaacattaagtagagtcttttgccttagaaaaggggcacttctatgttgggcaaaaacttttttactctgaacacaactagaattctttacactatgccccatgccaatgaaagagatcgtgaacttattataatgccatacatagctcctatacatctctcagtggtatggattgtgttccagtagcgaaaacaaaggcattttctatgcagtaatgttttcgccatgagacctacccttactgtcttgttttaaattgcagcctgtgctcatcatatactccaggtcttcaccctaacaaaagtctctaggacagtgaatagaaattctgaaagccctctattcaggaccatggtaggactgtactgtaccaaacttgcaagttcagcttgcccatctgatttattttaggcaataatatatgagcgcaaatgacaggtagcacttctggctgaatccctttaatagtcaacacttaatttaccactttctctaactgctgccacaggaaccagccttattccagatggttgagtgagtaacagagtctttgttgttaaagacattaagatttggaggatagttatattagcaagacctaacatcttctcacaaatataatttctttctatatgctatagtgtatttatagactatataatatatatacacatatatattttcttttttatcatataacttattgcattctaacatactgtacaaaatttactttgttggtaagtaaagtagtgagtaagcagaaagtagtaagctttaacctattatcagaatataaattccaggataaaaggggaactttttctattttgtttcatattgtgtggcaagcacttagaacatgatatgcctggcatatagtaagggttcaataagtctttggagaatgacactattcataaatgatgtaagtttcaaagatcattaggatgcgtaggaaatgaaattacttgaacaataaagataaattaaggatgttttagtgatatgacagccctgaaattccctaataatggatttatttcaatgggggagaaattggtttcatactttaagcaacaaggctctgggagctatacataggacatgcaggattctcagctctttcaaaaatgtaggggagatagagatttaggtttggattttatagacctatggaggacctcttgaatcaaatattatttgaatgaaaatgagtttagtttatgaagtttgtcagattcaatttgaaaagcaaattacaaattaaaacacacccacttcgtgtaataatttttaaaaataatcttaatagtttttttaatttcatagtttttaaaaatttacattgcactatccacaagcttcatctgagataggtaaaatataattgaaatttcaatatttagactaattatttgtattattaagagaggaatcctaaggcagatgaccttttgattagaataatcataactatcttaagcaaaggtagctggcatagactagtctagaatggaggttgagaagtagattacttcaggtatcaagtaataggctttagaatctattcttgcctagctaatctcttagggtctgggggccttagaacagacaagagaggaagcagtcaatatatagtttaagggagaaaaatggccactgaggcacaaaataacagaaagattcagaaaacttagagagcaatgatttcttagtctcaattttaagtggatttctagtccatgctattctgtactctgccttatcacaaagtcttttgcgcacattcttgtgttggttctacactgaagaaagaaggaggctggtgaagatgaaatgtggagtaacatgagtggaaaaaaagatcaacagtgatagagaaacaagcagggactcaatctttttggtgaacagaaagtcagtgtcaaggagaacataacatccatgagagtccataaaaaatcttgaagactccaaatttccaaattcagggtaaaaaagtacaaggtaaagacttactgtttaaatgaaatctctagtaagtaaagtaaaattcatttactcacctgtttttaaaattagggggaaaaagctttctatactcagataaagaatatgacatacacccaggtgtgacatcctttatatgaatgcataaaagctcaaagttagatgtgaatgaaattaaaacaatgtaagcccttattctctcatccactcaaatttacctctggagaggtaaacataattaagaaattttaaatttgcagattgggttctgtggaaagctgactctgaaaatgagtttttttgtatgagagtttatgatcaacatctgtggaaggaattgaaggatgtagaattggtcaaagatggaaagtgggctacagtaaaatttcaaccaaggcttcagtagagcccatgaagaaatctgggatgatctttcacagttattccacattgcagtaagggggttaggcctttctatcctaacaatgaccagtcactatgtgtgggccctgtgatcttaagaaaagcaagaatcttcaagaaaagactgacagcccacagctaccagcaagcagcccaactacaagctaagaagtggagggaaattctttaattctgagcaaggctctgggcaatacataacaacattcattaaagtatcatcctaaacatcttatttatgcatttcatcatatcacatgacatattacaatatagttaacacaatacaaattagcaaaatcataggttcattatactcattctactacatttttaaacactaagtcttagatctttctttagtttaacatacaaaatttttatcattcttttaaacaattacttagttttccatagtattgttataccataaatttcattaactcttcttataagaataaacatttatgtcgtgttctaatatcttctattagaggcaatgccacagtgaacttaattgtttaggcttgcatatatacagggttttttgtaagtatgcattcttagaaatagcatttctggatcacacatatggacaattgtggtacatgatgctaaattctccttgaatttaggccaaaattccccttgaatttaggtcaaaaataggtcagttcacatgccttcgagaggtacatgagactgtgtattttcacagctctaccaagactgtgtgttgtaattctttttagtttttggcaatatgatggaatataaaaatatattttaatttgaagtacccaaattgatatgtaactgaacttaatttcccattgttgtacataactatttgtttttcctctgaatcacctgctcacatcatttgtctgcctatattttttattgttcaactatttttcttgacatgcaggctttatttaaagctactcttttatttctattcaatatcttatattttaatttttgtttatggaatcataggccataagaatttaaaacaaacaaaaataacctcagtacaccaatactaaaatcagtgaatcaaacaggaaaaattataaatagcaacccaaatatgtttttccctttaccaaaatttggaattcatctcctgttagtgatgttatagcaatacagtgtccaagaaggaaagaaagaaatcatgctaggtatttcacacagaggggatgcaacgtattgaattctttataaacatgttgatttaaagtttaacttttcatttgacagtgcaaaaagaaaaagaaaaggtggggaagtcaaggaggtcccaccccttgacttctcagtattattttcaggtacttctttggtcaatcctagaaaaaaactgttcaacaaattgttgatctttagtttcctctcaatttctcttttgttccccacttatagtatcaaaatatgttcttttcccttaaacaaaatgtctctagcagtttatttctgccctgaagccttccaatcacagaaagaaacaatcaaaaacccatttatcttgcgaagctatttgtaagataatgagtcagctcttttcaaccttgcaatcttttaaagaaccacaataaaaggaaactacttaaattctcaaattaatttattctggaggaaattgggaagccatgtatgtatataaggtggtataaaaaacagggcagacagcaagtatgtatgtttgggagggcagtgcttcaaatcattccacgtacatgtgtcatttactcctcccacaaagatataaaatgcaggaaatcaacccacaaagtgtagccaggtttccttttcccctgtgaactggaacacttggaaaaaaccagcgtgtctagaaaaacaaaagataatgttttctaagaaaacagtaacatggtttcagcagaagaaagccatatgagtgtgcttaatgttaaacatgggagctaaatgttcaattcaaaatattagttttaactgttagccctttgtgccactttgtgacattaaaaatttcatacacctttcaagccacagtctctacatcaataaaatgtgaagatttgacaagtcaagtgcccaaattcctctcagatttaaacgttctgtagtctatgatcctggctttctaggtctttaagcagtacagccactctcttcaaaaccagacagcacctctccctctgctttaggggaattcaagagatatcagattaatgggacacattatgattagtaagtctagaacattggagtgcatcaagtcatctggtgattttacaaaaagacaaaaaagctcaggcccctccttgaaagttctgggtcagtaaatttcagtaaggtcccatatccctgcaattttaacaagcttgccaggtgtttcttatgcctaccaaagaactactggtttcaattttggcatttatatataatctctgacctacacagtggtctaatttcaacatcaaggggttaggatagacttgagtgtttttttcctctataatttttcatatatatatatatttgctcttacagtagaaatccatttaagtaaactgcactactggaaaattagtcttttcaaactgatagaccttttgctatcacaaattattgactgctctggatacaattttgtgattttgaaaactcaaggtgtaaaatacactttgcaaatctctctgagaaagattgcttcagaagttgagaagcaatcaacttttgctgggcacagtggctcatacctgtaatcccagaaatttggggggccaatgtgggaggactgcttgagcccagaatttcactgcttgatcccagctgcagtgagctgggatcacaccactgcactccagccggggcaacagagtgagactctgtctcaaaaaaaaaaaaaaaattttgagaagtgctgtgtgggagactcctagcataatgagcagagaagaggtgctgtccaaagtcaccatggtgccaggatgatagcggtatcatttgtatcatgggatttaaaatatttgagttcaaacacttcctgagaaaatacaagaatcatttttaacgctaatactgaacacatctttgactctaaatctctcattttttctccacttacaaagaaaggagcgtccctcctcctgaataaaacctaagtaatctgtctctgaatttgatcccatccaattctgaatccttaggtccttttcccattctcccatcacagacattatagcaccttcccatctctccttcatttatgatggtttttgtctactttgagatatgcactggtctcctcatcctttgtcagataaaaaatgactgttacctgcatctgctgcttcctctaatacactcctgttcctcaccttcctttcactaccaaacatttcacataaaagttcatgaattacttcactcatcttctccataaaaaccagccttcttatttatgttattctgaataccaaaatgcacaaaatctagttctctctctctctttatatatctatacgtataggaaggtagataaatatagatatatctaattagctaaatccaatgccttttctgccttcttcacatttcttcacctactttgtatttttgctaaatatgtcactattcacccacccactctgatcaatgaaaatgttagtattactacaatagcaaataaactgtgtttcacttgtcactaagtacaaaactttagtggcttaaaatagcatatgtgtttctctctcatgaaataagaccaacatgggttagttgtggaatgtggaagagaggactcagctcatcaacattcagggactcaagatggaagaatggtgacctcttgaatattatcatttaccaaaccagataaaactctaaagtgtctcacaccaattattaatttcttcagcctagaagttgcacatgtcaagttctctcacacaatattgtccaaaattacacagcccaccaaaccatagatagtccaggaaatgagatctcccagttgcttaaaaagtaaagaaccagaaatatcttgtgagatgcataatccataccacaaatatttttaaaaatcctaggcttacttaatactaaattagtatggtgttccactttggtttattttatatttcttcttacactgcccccacatactgtaataaccctatattctactctttctgcactaacactcctatagacctcaccaactttcatgtagttaattatctcttctatgtcaataatttttaacctatattttcaaatattcttctactacttgtatcactcaatagcagacagggtatgtgaaataggtcctggaaagtgacttcactttatgatgaagtcacattattaaaaagctgtcctataacatcataagttccataagcaaaggcttaagaatgagagctcttcagtggtaacacaacaggaaatatcatcttgggatacagggagatagatggctacatctttcccttcaatttttcaaataatagactgtattgtatctgataagagaagatttataatcaaatacagcaaatatatttcagcacatactgtgtgtcagactttgtgttaggagtgttcacgtttattgtcttgcttaatccttacagcaataaaagaatctaatgatttaagataagaatatagaggtttaataataaagagaataaaataagtcttaggaaaaagcagaaatactttagaactttccacccaatctcattcacaagtaactttgtgataattactgtaaaggcagaatggtttgaataccaagacctctgactgtagacattcctattgcaggcaacattttaaaaatttcattcgatggatctcatgatctagtagtaaaattgctatgcagcgttttaaacacaaaactataaatactttatgaattatctaagaaattttcaaatttaatttctactatatgtgattttttggtcaccccatctctgcaaggtaacatgcaaatctgtcacatatgtatacttcctgtaattaggacaactaagattcccacttccatacagtgacattgattcataacctttttctataacaaaacaatggcactttttacataataccacagttataacataagtgtgaggaggtaactctgttacctcctcaaatatttttctactcccactagcagccgcagatagaaatcctataaaacacagtattttaaaagagacaaagtgacagctaatataccataaataaggggagtccatctgtatagaggaccaaatataactttctgtctgacacattcccactactcagcccttctgcaaatgcagagacaagttacttgtttcagtctttaaaaaatgtgtcattaacccagaagctttgccctgttcttttgcctccaatctgctttatcaccatttgcataattagtccatctgagtactactttgttgcctgtacccccagatctattctaccaatgccagcaggaggaccagaaggggctcaaggaatcatgcactctatcattttataaaaggagaagctctggttcttaattgatcattacagcagttacagatgaagggattgaacccaactgtgtgttaacattgtcaaaggaacatgtaactagattctaccaggaaaattcaacaaaagtttagcctttccatttttaactgtggctacaattttcaatgcagtattttcaggacaaaaatgtagtccctaaaaaatgttctcctcctgtgttgagggctacagaaatgagtactttcagaatatagcaaattttacagatggcatcatgaaataccgtattttctctttcttttcatgctatactatgcttgcctcttacttaccttactgatcctcttttatttctttctattaacgtctgttctatggtttctttttatcctgacagtgttttgatatctcctaactcaaaatttttggctagttctcctaacttctgttcttagctctcttctctaatgtaatatttctatagttgagtccaccagtaatgacagccatgttcaacaattctgaaacacagctgggcgtggtggctcatgcctgtaatcccagcactttgggaggccaatataggtagatcacctgaggtcaggagttcaaaaccagcctgaccaacctggtgaaaccctgtctctactaaaaatacaaaaaattagccaggaatggtggcaaacacctgtaatcccaggtacttgagaagctgaggcaggagaatcacttgaacactggaggtggaggttgcagtcagccaaaattgcacaattgccctctgaaaattgtttccatagccttataatctgggagaagctgaggttaaaaagtttaagaacataataattaaggttaataaatctggatagggttaaacttcagctccatcacttactaaatatgttttaatttcctcttacataaaatgaggatatggcaacataattcatgtgattattgcaaagatcccattaaaaatatttgtaaagcactgaacacagtgcttggcacatagtgtttacagaatttgagggcaagtaacttgataagttttggatgggtccccactaaaatctcatattgaattgtagttcccataatccttacatgtcatgggagggacctggtgggaggtaattgaatcatgggggtagttaccaccatgcagttctcgtgatagtgattctcatgagatctgatggttttataaagggcttttcctccactttgctttgcgcttctccttgctgctgccatgtgaagaaggatgtgtttgcttccccttctgccatgattgtaagtttcctgaggcctccccagccctgcagaactgtgagccaattaaacctctttcttttataaattacctagtctcaggtatttcttcatagcatcatgggaatggaactagtatagtaaattagtactgggtagtggggtgctgctataatcatacctgaaaatgtgtaagaaactttggaactgggtgacaggcaaagattggaacagtttggaaggttcagaagaagacagaaagatgtgggaaagtttagaacttcctagagacatgttgaatggccttcaccaaaatgctgatagtgatatggacaatgaagtccaggctgaggtggtctcagatggagatgaggaacttgttgggaactggactaaagtctctttgctatgcaaagtctgggatgcagggcatgaagtcaatgcaaagagactggcagcattttgcttctgccttagagatctgtggaaatttgaacttgagagagatgatgtagggtatctggcagaagaaatttctaagcggcaaaatgttcaagaggaagcagagcataaaagcttgtaaaatttgcagcctgatgatgtgaaagagaaaaaaacaattttctgtggagaaactcaagctggctgccgaaatttgcataagtaatgaggagccgaatgctaatcaccaagacagtggagaaaatgtctccagggcatgccggaggccttcacagccatctatcccatcacaggcctggaggcctaggagggaaaaaatggctttgtgggccaggccaaaggctctcccgctgtgtgcagccttgggacttcaggccctgcatcagctgcttcagctcctactatggctaaaagtggccagtgtacagcttgggccattgcggtagacggtgcaagccccatgccttggcagcttacatgtggtgttggtcttgctggtgcacagatgtcaagaattgaggtttgggaacctccacctagatttcccaggatgtatggaaacacctggatgtccaggcagaagtttgctgcaggcacagagccctcgaggagaacctctgctagggcagtgcagaagggaaatgtggggtcagaactcctagacagagtccccactggggtactgcgtagtggagctgtgagaagatggccaccatcctgcagaacccggagtggtagatccactgacagtttgtaccatgtgcctggaaaagccccagacactcaatatcagcctgtgaaagcagctgggagaggtgctgtactctgcaaaatcacagggtggagctgcctaaggccacagaagaccacttcttgcatcagcatgagctggatgtgagacatggagtcaaaggagatcatttttaagcctttatgatttgactgctctgctggattttggactttcatggggcctgtagccctttcattttggccaatttatcccacttgaaatgggtatatttacccaatgcctatactctcattgtatctaggaagtaactaacttgcttttgattttacaggctcataggtggaaggtacttgccttgtctcagatgagagtttggacttggactttggggttaatgctggaatgagctaagactttgggggactgctggaagggcatgattgtgttttgaaatgtgacgacatgagatttgggaagggccaggggcagaatgatatggtttggctgtgaccaccccccccaaatcttatcttgaattgtagcttgcattatccccatgtgtcatgggagggacccagtgggaggtaattgaatcatgggggtggttatttcaatgctgttctcatgatagtgagtgagttctcatgagatctggtgatttcataaagggcttttctctttttactcagcacttctccttgctgctaccatgtgaagaagaatgtgttttcttccccttctgccatgattgtaagtttcctgaggcctccccagccctgtagaactgtgagtcaattaaacctctttcctttataaattacccagtctcaggtatttctttatagcagccatgagaacagactaatacataactcttgtgaattttgaaattcagttaaagaaatgtttcactgcctgaaataaagtggctctctctgccatctaaacttttaaattacttagtactactggaatataacagaagattcatgcctttaacagggatgaagcaggagaaatcagtcagaggaaaggagggttggtaaacttgatctttgccatctgttcaaattgcactgagtatagtgaatctttttaacagaagtcatttttcatctactgtatgtggctttggcaaaagtagtttattattgttttagctttacaccatagacccaagatatgaatagtgggaaggaaatattattacagcttggttcccctgtattctctagaagatcactagaatattgatttccttttggcctgattcactgtacaatggttttatatgggtgggttgtaagaaacaagaatttatatatatatatatatatatatatatatacacacacacacacacacacacacacacacacacacgcacacacacacacatatatgcatatataattatacacatacaatttcctgtctgtttattatccataataaacacctatttttattatttcaaaataaattacattgagatttcttgatttgcctggagaaataaggacaaggtgcctagctaaaattagaattaaatgactggattttagagacaggaatacgagcttgactaggtcccaacttacactatattcaatttaaaaatctaagaaatggcaaaagcaattcaacacatttctagaaattaaatggtaaagcctaagagtgaaggctgaaacaatgctactgaattaagctgctgcaatcattatgtacctgtggttcccaattttaatgtattttcactgcatcaggaaaacttccagaagactaataaaggtgttaagaagtaaagctaactccgacatacagtctccctggcaatatatttttgtattttgttttgttgtaatgctggtgacactccagtttggtgcagccacaggaactgacattttccaatcactctggcatttacagccccctcttcactccgcatcccactgggatcctcctcctcagaactcaccggcaaggctcggcctgccttcgccactgccagtcttgtttcattttggtttgatgagtggaggtgcagagagggtgagagtgttgtaactaaggacagaagtgaatgatagcacatttgtattacgcagccacccttttctattcccaactgaagatcacccttagggatatgtggtttaaaaagtagctgagagaaatagccaaaggaagaggaaaatggatgcgagaaagaacgtgaaacgagccttcataccactctcactccagtctccctttcctctattgcagtttttctcttctctatgctgatttttactcctcagacaactctattccagattccttgtttcttcatttgtgaagctcatcttcatctctgcatgtccttgtctctgtcttactcgaagccaatctcagggccatgcccctatacatgtttttattaatccaccctgagtaatatggttggtaaaattcaaagtgatcaaaaatgccctttgggattgcatatataatgtgaattcccttgctactttatatgactacatgagaaagtttgaactctctgaaataatgatagggcactataaaatgcacggcgttattaatataatcatattttttcatgttataagtaccagaaatagcaggtgtctgtattctgctaacaagctctgtagctacacatgctgacatactgggagttctagaggcagttctaaataagtataaaaatgcaacaaatggcaaaccatttattaatctctttaagctaaatttttttcaagttatttttacagtatcttttaaaacaaaatcccatatgaaagtaaataaattctaaaaattataaagcctagaatttcacagcattgcccaaatagttatgagctttgtccatatgtcagtagagttacagtaaacttagtgattaagtttttcactcaacacatttccaataattgctttttctggatagtgcactgtactaaatcctatgggagatacacaaatacataaacaatagtccttatgctctagaattttaaagtttggttataatggaaagcgtatagtcaaataaacccacagatgaatgtcaaataaatgaagcacataatgtatagtataggaatttagagtaggaacaaatcctttttggagaaaatgattgtagaagttaaaaggagcagacagcatttaaactggacactgaaataaaattctacttggcagaaaattgaagaggtgattaaaatagcaataacaacagcaattttaataataataacaacaaagcaatcatgatgaagttcatttttggagcatgtcctatataataatttcaatgttaaccctttatctgtcttatttcatttaatattcaaaacaacccgatgagctaggaactatcattatgctattttcaaagatgaggaaatttgaacttaggggaataaaacaattggtcaagaatatagggaatataaataaaaagaccatagtttgaaaataggctattgtacaacattcaagcaaatgtactggttccagtctgtttgtcttagattcattcattgttctttcttgtctctattttgtgtcacatgatagcagacccatacatgcagcttactttttaccagattcagccaaatagagacactgatgggatatgacgggttagaaagaagctaagagatttctctccattgtctctctactttggttacctcttccagcagccactgtgtaacctccctggctctactatgtgtgagacaaaacacgtatggtccagtattgaccaggttatctggccctgggctccctcacaatcttctccttaactgtccagtataggagttgattgaagtagattcctgttcttgctaatccctccattatcctgctagcccttctttacttctcagcaatttcatcactggtgctactaatttccactatcaaactcccatttgtagagacttgatgtgatttctattttatttttatctatgagcaggtacaataaaataaaatttcaaaatatatttaatagaaaggacacaagcaaagatttcaaagtgaggaaatagtagccacatttacaaagctaatggactagttttattggagtagggaactcaggaagtggaattctgagaatgagttttgaaggtacaagatggtggatgagtttgaatggtggggtttatgcaacaggaaatacagagtgattcaaagtttggaaagagtaatctgaaattcagcagtatgggtttggtgaaggaatgatgtcaaagaaaaactgcaccaaattgagtaaacgggcaaggaagaatattgcaacaggagtcaagatgattacaaaaggaagagagattgcactcaactctgctgatgtagaaaaatgggagagatgttaagtgccaaagatagctagtggaaaagaactggaggacctcagggaggaagttggtcaatgtgattaggccatctgtgtgtgctaattgatgcttatctaagttaggctcctaccctcccacagagactgaaaataggggtgctatctttcttgatgtttacatttcaaagggatggcttccaggtccttgagaaagacattcctgggttataaaagtcagaagacgctgggggatttatatctcagaggggcaaagaatttacaattgtactttttctaaagtaaatgccttaagaaaagaaaggtcagggacctacagtcaagaagaaacctgtctaaaatttagtcaagctgaggagaacattaaggacatcttgatcagtgaataaaattaaggagaccagtagaaggtcatataaggtcataatctaaaggtgtagcagagaaaatgtgtaaaaataatcaacagaaattgtctgctggttagatataggtcaggaagaataagaaagggcaaatacaaggtaaactcaactatttttctcagagggatgtggctttaatataaatgaaataagtggaaataataacccattggtataaggggaaagccaattgaatggatgaccaattcgaattactagattgataatagtcattaaccagtcgaggactagcaaacctccaacaacatttattagatgtatttctgtctgagagaatggagaaatattaattatttaaatgtaaccactactttgtttccatgtggtttttaaaaacatattttgaagacaaataatgggaaagtaatatgtatcactaaaaccttgaagtgaataacataatttgatcctatttttatctttctctaggtaaaggagaaaaaaaaaaagatagggacgaaataaacaagaatgaggtgatgtttgcccacattgtgggtcaatgttttcatatatttatctcatgtaattctcaaacaaccatgaagcatgaagaagatattatctaccctatcttcagattaaactttgtttacaaggtaacaaccaattgcagagctgcctttgaatctaagtctaccgaacttcaagatctatactctgtttgctacaacaaggtgcttgggataagtagacttcaatgagcagagaaattgattggaacttgcatgaaatgatgacaagtttttctgatcaaaggcctttgctctgctaatgcatcaaattacaggtggtttcctcacaaacactcaatttttgcagagctattcacacttcaggtgaaagtatatttttttttcaaggattaaccattattattggcttttcatatgttaactaaatccatgctgttgttggaggcagtgctacagtttgatgtgcttgtttgccatgatgcaacttggtcgccctctggaggctatttttaggattgactagcaagtcttaattttgaagaaaggtcttaacaatttaacaactcattttaaaggtgtggaaattatgtatatatcatacttaattttaaagtttcaaagcattgggtccaaaatattgagagactattttaaaatgttcaatttaacattttatggcacagaatatttggaatttcactttccctttggaaatacagatggtcatgattcccttttcatcatggaaaatctatctatactggggttctttttttcttccccactaagaacacaagggcaattagctctatataataaaaaataaactatatgatataatatttttcactttattggaaacaaaatctgtggttttaggtacagaaacccatctctatatttccagattatttgtattttcctttctaccagagacaaaagatgacagcttacaaagatctttctaaacagaatgtcttgaaggataaaaatgttttgttccctagttcgttcttttcagtttttttgttgaaagagtattattccagttagtgaaaaatatacaggcaaagtgttttccatatatttatgacagctgccatgacttagctataactatttttcacaaagtaagcagttatgagttgcaactttaaacctagtgattctttatttgattaaatgaatgtcagcttttaaacaaatgagcagatggagaagtcagcctcagtcactatttggagtacatcatacaaccagagttgtataaaagtcctgtaacatgaatttgttatggaggtctctccagtctcctgagaccatttcacactgtttctcactgtgactttatattccattgctaaatgttttagtgcagtgtttgagaccctgaaatatttatttttttaatttttaaattttatttatttatttatttatttatttattttttgagacggagtctggctctgtcacccaggctggagtgcagtggcacgatctcggctcactgcaaactccacctcccgggttcatgccattctcctgcctcagcctcccgagtagctgggactacaggtgctcgccaccatgcccggctctttttttttgtatttttaatagagatggggtttcaccgtgttagccaggatggtctcgatctcttgacctcgtgatccgcccgcctcagcctcccaaagtgctgggattacaggcgtgagccaccgcgcctagccgaccctgaaatatttaacaagacaaatacataatgcttactacatggcttccttatatcactcctcagttatttccttgtaacaactggacacagccccagggccctatccagcagaaaggtggtgtcaagcactgcgtgttgtattctatgatctttggccctccaattgccttttagccactttcttgacacctcaacacatgttccagcagaacatttcttaaggcacagacttttagggagtcttgaatccatgctggaaatggagaggggagaatggaggaagagaagggaaaaatacaggaaagacaaacacaaatattttttataaatctttcagccacaaaaattataggcaccatgcagagcaagtggggaaatttagattcatgcattaatttaccaattagaatgacagataagagtgaataaagaagtatctaagaggtaaattggataggattggcaattgataggatatagtggatgatgagagagggtgaagtcaaagttaatggctagacttctggtttatataactgaatgaatggtgccaccatacactaagacaaacaaagatggagcaggacagattagaggttgcgggagagcatgcatatgttgagttttatgtttatttaaaataaacaggttgagatgttaaataggtactggatatacagaatttaaaactgaggtcttggatacagcaggtcctcaaataacgaagtttaatttaacatcatttagtcataaagttgatgagaaaaaaaaattaactcccacctgaggccacagtctacgtggagtttgcacattttccccatgtctgtgtgggttttggcctcatactctggttgcttcccacatcccaaagctgtgcacattagctgaattggcatgtctacatggttccagtttgagtgagtatgagtgtgtgagtgagtgtgacctacgattggatggcttccctgccagggctggtttttgcctggaaccctgagatgctgggataggttcccatcacccaccattctgaaatgaaataagcaggatggaaaatgaatgaatgaatgaatgaatgagtacaaattattgtcaagtaaaaatttgttaagtacatgacaatcctacaaatgcacatttattatcatgccaaaagtgctcagggagcatgctatatttcctattatttgtttttgaactttatggtacaagggggtactcctgaaaattttcactttgcaaacatttatttcataatttaacccatcactgctgtgactgccatcattcactgattcaccaaaaaaaaaaaaaaaaaaaaagtggatcactaactatcttacttgattttatcaatttaacttaaatgtatgtgtagctcacatttatttcaatgtttaatattagaagtgtttttgttttttatttataagtttggtgatggttttgttaccaaaaatagtccattagaacttatctcttatttatatctactagcctatggaaaaattggtttcattatgcatagttttgcttaaagtcagagttttcaaaaatctatccacaatgttaaaagaggacttattgtacatgtatgtccaattttcatgggggtggaaattaaagctgtggaaagaatttatatttccataaaatatcttgataattttatagaaacccacatattttatgctactaaagtgagagaatataatagtctagaattgaattttgaaaaatttcaacacttaatgtttggaaagaagatgtatctgcaaaagagatggagattgagcaaccacagagataagcgaaaaccaggagagtcttagcccaaggaaaattaaacttaaaagagggaagcaaattctacttacagatcaagtaactataagattgtatcttttagtttattgaggacatagagccccaaggcccaagccaacaagaataggagatcgagaccatccttgccaacatggtaaaaccctgtctctaccaaaaatacaaaaaattaagctgggcgtggtggcacgtgcctgtagtcccagctactcgggaggctgaagcaggagaattgcttgaacccgggaggtggaggttgcagtgagccgagattgcgccactgtactccagcctggcaacagagcaagactccatctcaggaaaaaaaaaaaaaaaaaaaaaaaaaaaaaagaagataatatctacccattgcttctatgaacttggaaattagtaataaactgttttttattggagtggtaaaggctggattctgttagaagtagactaaagaatgagtaggtgatgaagtgaagatactgaatacagaaaaaaacatttcttaggaattgaaaaattatggttttgaaaaagaggagaggggaaagataatcaaagcagaggatgtgtggaaaaatggtgagtttgattttgcatttcttctttgttttattcttctttttaaccgttttttccctaatttggaagatgttttaatgctaatggaagggtgagaaaaatatattaaataatataaggattctgagaaggtagaagtagatgtaatccaaagcaggattgaagaaattgcctttagtataaacagggcttttgttctattaaatgaccaaaggggataaagatgggagcagagctggtaaatgcattatgttcactaacagaaaatttcctctctaatgtcttttattttcttttctgtgaattagaagagattatctcctgatagtacagcaaatggtgggaatatagacagttaaagatagtgtggaatgatagaaaaacacattgtaaagaatgtaatgactgttcctgataaacgaagcagaattaaaggtcaatattgaaggatctttgatgtcactgatcatgaatttataaaggaaacaatctaaacctttatgtaattttctcaggtagccttttaaaggtagaggtcaaaaaaagtgaaagcagtggtttcgggtttatccatgtttggatacaatgaaaagacactagagcaagggagtttagaatacaatcagaaataataggcattggaatctaaaataataaggaaggatgtaaaggcaatattaggagaaaataaagaagaaaatagacttgtttcaaagtacaatcatggtacagctgcgatttgaacaactaaactggaatgtgagaagtttgtttcaagggcacgcttgtgttaatgatttgggaggtggaactgtataatttttgtttgtttttgttttaagaccatgtctccatcccttttctctgatttttattgtagaggatagcctcacaaaattgaattttccagtatgccttgacaataagcttcccattaggtttgaccaaagggaagcactgatgagataatggaaggagggaataaaggagaacacagaatgccctccttttttaatttttttttttttgagataggatcttactctgtgcccaggctggagtgtagtggtgtgatcatggctcactgcagccttgactccctggtttcaagtgatcctcctgcctcagcctcccaagtaactgggactacaggtgcatgccatcatagttttgtttcgttttgttttcactttttgtagagacagggtctcactatgttgcccaggatggtcttgaattcatggcctcaagcgatcctcccaccttggcctctcaaagtactggattacaggcatgagccactacgcccggcttgccctccttccttgaggggcatagacatctacatctgaggctttgtctccttcatgggtacaattcctgttagagattttctccctctatattaccagaatcaccagcacccattccaattttgcttagggaattccctcttgccaaactctgagtagcctccttatccccattttgactctttcgctttgccaatctttgaaaagaaaaggttattgtattaaaatgtgctttctaaacttcctgaagcagaccatccgtccttcctgaactctaattgattagtcccaggaaacaaaccttcaaaataagactacagaattgttgtttatctctttgagcttgaatgtagtaatgacctcagtaccaatgtaaagaaaacaagcacttcttccaaccagtggaagcatgattatttaagttaccaccagtgtttgttttggataaattgccagtcaaataaaatccttttggaggtcaagtgtctactgtgttcattgtggtaataatatctataagcactgtggggtacattagctgcttctgacaacaccagagagcttacaagatgcaaatgataagttgagtgttaaacctctcagatcaacgcatgggaagagacatagacagcccctatgagggacttaaatgtttctcaggttttgtagccatagagcagacatggctgaggatcaagcttcaaatctaaatttgtgggttgcagaattaaaataaaagctcaatgcccatctttgtattgagtctcatagattaacatcaggacatcgatcaagaaaaaattcagtattaaagatttaaggtaaggacaggcaggcagactaagattaatatgaaaacttttaccttaaaacttcctgacgtttccttgacagtgaaaacaaaccttcatctcccaaccccagtctgaggaaattcagcaatgtcttttgctaaacatacttctaaagaccttttctggagtacttaattttcaaagagtgtctacttttctcaagacccactcacattagcacttattttttcccagcctgtaactattcagagaggagaaagaaaaagaaatctgtcaagcagacagttgggatgggtccttggtaaaactccttcaaacagaaaaacacccagaaaaatcaaagctacaggcacagatagagcagcctggggaaaaatcaagttacagttgcactaataagggagcaaggcccaacatagaaacgtctctgttctttgtgtaatcagtgggatcccaggaaaaagtttcctccctttttcaggcatgtacatggtgggctccatgggaacttgcacaggggggtgggggcttacctaaaacacacagttgcataaacaagagaagctgcattttgtacttgcctaagagatgcccgcagctgcacagataaagagagttacagacagctacacagataatggaagttacacaaacagctacaaagatgaggggagtttctcatacaagcttttggattcaactgtaaaaacgacaaccctctttcaggccccctctccgctgtggagagctttcttctttcacttattaaactttcgctctggctgggcgcgatggctcacacctgtaatcccagcactttgggaggccgaggcgggcagatcatgaggtcaggagttcaagaccagcctggccaagatggtgaaaccccatctctactaaaaatacaaaaattagccgggcatggtggtaggcgcctgtaatctcagctactcaggaggctgaggcagggaattgcttgaactcgggaggcagaggttgcagtgagccgagattgtgccactgcaatccagcctgggtgacagagcgagactctgtctcaaaagtaaaaatgaataaaataaaatagagcatataatgtgaatttttctccaagtcctcctcaaagtggtttgtaacaattttctagggggattgtttaacaagaaaagggggaaactcagaatttttcagagattattaagctaatttcacatatctgaggttcaaaaacatcactgtgatcttcaggtcatagtggggtttatggaggtcatatgataattggagacttgatataaattcacctcactataacgtctgtggattcagtaagctacactatatttccccatgcctgaatgcattgttggagacatacttagaaaaaagaaaacaaaattctcatccatagcaagagctattaagatggaaagggccatcacttcacatcaattagaatgtcgatgatttaaaaaagaaacagaatacaataataaaaataacaagtagtgatgagcatgtggaaacattgtaactcttgtgcattactagcaggaatgtaaaatggtacaacctttgtgtaaaacattcggaaacttcctcaaaaaaaatgaaagacagaattaccatatgatctaaaaattcctttccagggcatgtacccaaaataattgaaaggaaggactcttgacaggtatttatagacatccatattcacagcttcattattcacaataccaaaaaggtgaaaatgacacaaaagtccatcaacagattaatgcatcaacaaaatgtggtatatgcatacaatggagtatgattcagccttaaaaaggaagaacattctgacacatgctatggcatggataaaccttaaagacattatgttaaatgaaataagccagagacaataggacaggtattgtaggatcccacttacaggaagtgtctagagaagtcaaattcatagagacacgaagtagaatggtggctgccaggatcttgggatggggagaatacagtgtattgtttaatgggtatggaatttcagtcggagaagataaaaaaaagcctggggatggactgcagtgatgattgctcaacatcgtgaatgtacttagtgccagtaaactgtatatctaaaagtagttaaatagtaaattttatgtaatgtatattttaccacaataaataaagatagggccaagtgggagccgctgtaactgcccatccaattcaaaataatacatattattttaaaatgtaacaccacctctctggggaatttgcagagactaaaataaccatgcagatggtaagctctgttgcctggcccatttaagtaatctgcttggcttataaagaaagttaaatggattaaggacaatgaaatgatgatcataaagtaatgaggtggcttttctaaaaaaaaaaactattgggttttatgttttttggaggcattttttattttggggggcaacttaagacagtgctagctgctgctatacagctattgacctggaaaatgctctttgtctccatatcaattagtaatcatgatgagaggtagtttatgttaacctgacaaagatagaagtacacttaaactttgtttggctttctcacgggctgtgccaactctcctcatctctatagcactatagtccctggggagattaatcacctggatgtcacgaaaatattatggtagttcattatattgataatattattatgactggatgtgatgagaagagatagaaactgcctgagatatgtcagtaagacacatacatgtcaaaatgttgtaaataaacaacatgaaatttcagagtgtcgaatatatcacaacctcagtatgataatgcatgcagaaacaaactccagaaagcactgaagatcagtgcggattttgtcttttggggggaggcatcacacagcacacagctaggcttccaaaatattctttttatatatccccaaagtcccattcgtgctaattgctgctctttacttttaactcctctttaatgtactcacttgccctttgttgttccccattcttcttattcatctgccctctttcatcatttctcattgagaatagcctgggccattctttatatcagcctctctctctcttacccatagcccgtcccccaaaaaggctctgtgctacttaagtaagtggatacctcttttcctcagaagattgcagagggaaagggtgcgggtatataagaaagcctgataatttaaatctctattggttcccataaatatattacatcttaaataaattcatacatgcagtaaccacacaaatcaaaaatgttcacaagctaccagactgtcaaattatatatgatatgcaaaatcacatacacatactatctgatttacaggtttttttttttttttggaaggaccccgggggttttgggcagcagcaggaaccatgtaaatgagagctctataattctataatatctaattagcactgacagtctccccagcatcagccatatcctcactccacaggctctgccatggtgagagggcatcagtctagtgaactgctggtcggcctcaacccaaccaagcccttcactctgagatgtcactagagctcctggttactttttttccccctagattattggggaacaggggttgtttggttacatgagaacttactcatgatttacagtttctttctttctttcttatttttttattttttattttgaaacgaagttttgctcctgttgcccacgctggagtgcagtggtgcgatctcggctcaacacaacctccacctcccgggttcaagcgattctcctgccttagcctccctaatagctgagattacaagcatacaccgccatgcctggctaattttgtatttttttttttttagtagagacggggtttctccatgttggtcaggctggtctcaaactcccaacctcaggtgatccgcctgcctctgccttccaaagtgctgggattgtaggcatgagccaccgtgcctggcctatgatttacagtttctaattaaaaaaaaatgtgttatcacaccatttaaaaatttgatttaaataaccaaaaaacaataattgataaactatcagaattgtaaatgtctacttttataaaggtaccattaaaaatgtaaaggcaagccacaaactggagaaaatattcatgaaacacgtatatttgacaaaggatttgtatccaggatattttaaaagctcataaaactcaataatacaacagtatttgggagaaagtgtactgataatcctcaattcactttgaaatatatctaaaacataagatggattgatagaagggcagagaaatggatagataggtaaatatgtaataaattcagaaaaaaatgttaatataagcatgtaagtgataagtatatgagtgttcactattaaattatttcaaactttgctatatgtttgaaatgttcataatagcttgttggaaaaagttttcatctgactcacataactaatttttatgctgtacctcataaagctaaatttgaagcaacaagatgttgctatatcctttttaaaaaatggaggaataacgtctagattttccaaaatatgtaataattcatccagcatctgcagttagagtatatgctcctaaaacctctagatgataaattctgtttgacagtttgctcctcttttcatccttgaaatatctctgggggagaattttgccagtggtgcatctttcattcacatgttaaaacaagcaaacaaaaaaaaaatcatctatctggccacctcctttggaagagctccaaggcaagtttcagatagcatgaagcaaacattcctacagagtatatatcttctttttcgtaggccacaataagatgaaattttaagagatcaacatgtgaatgcacccttgcttccaaaagtaacatttactcttatattttgcaacccagatcaaaaagagtggggattttaaagggcaaatatttttcctatcaaattttccttcttcagaaatgaaaaaagcaagatttgaactgtgagtaatgtatttttatgtttgtgttgaaactccatattttcaaagtctattgaatgtctcagttcaactaaattcttataaaagtaataagaaaagatgaagaaagaagtaagcagtgtaaagtagaaccaggggaaaatataaatgcaagagattgactaaatgaaccagagggaaaaaggatggagttctagaatgacactgtatatatatggccagagtcagatcagtggcccctataagagaataaaggagagttgttttaatccttcatccatagttgaggctgtttgacagaaaagtaatctactatgacctttaaaacctttctattatatgttagcaatgtaggtgttaacccattgcaagaagagtgatatttccaacagagctgcaaaccactagcttagaaagccacatggaaaaagaaatacatttcccgttgtgagagcattgtggttatgtacagtgcagtgcccggtgcttatgcctagctattggatgctgaggatgttgaccacacttgctatcccgtccatattcataggtgcgaaagctggttaaattaaacctcaggggtagtcctgctgggaaatagcaattcataaagggccagtatgtgctctgagacctgtgagtccaactggaaaaaaagaaactctgccagttttctttaacgatagaggtagagcttatcttactaataaaattatgcaaattattatattgctttaaaaaattcctgccgtgtaacatccttgtggagactatttaaattatggaaaggggaaaaagaaatagctggcagaagcagcttcccttaccatgaatcttcatagtctgctctagtgcagatcactaggtcagacttaaacttggtctaaatcactctactacagacccccagaatgaattaaaacattcagaattgcttttaactaattattacatgtcgagcactgttctaagcagcactcaaaaataattgaacatgcgttcaagtcatagtcaaggtttatgttcactcttgtgtcaccatctatgtcagtggtgacctttaaattgtgttgtgcacaaatatacagtcacgaatggtggttttttgggggtattaagaatagaacaatgaacaatatagacgagatctctgttctcatggaatttaatatgtactgtctagtttgggaaaaaggagaataaatgagtaaaataaacaaaagtttcaggtagtaatgagtcacaagcaataatacaacacgttatgcagtacagagtggcacgagtcacagtaagggaatagttacattacagataatatgattaagaaagacctctcccaagagtatatcttttggttgaagctgagtaagtaagagccagccatatggaaatctatatgaagaacaatccagccaggagaaatagcaaccacaaaggccctaacatgggaatgaggttagagtattcatgttccagaagttgacagaaaataaatatggctagagtggaataaataggaggaaagttgcacaaactgtgagtggagtatttgggagatgctatatcatgtaggccctgtaatccattgagtgtgattttcattcaataataataggaaaacattatggagtgttgaagtgcaaaacttaagcatgagagatatatgattgaatttatgttttttgtagattacttatggggaatttcctagaaaccaacaagaattcaagaacagttagaagtccattttaatagttcatgtaagggattctagcggcttaaagtgatagaagtagagatgaacaaatcaccaactaataaataagttttcaagaactaacaaattttcaagaacatttagataattcatctgaaatacactgtgtgtgtgtgtgtgtgtgtgtgtgtgtgtgtgtgtatgcacgtgcgcacatgcataaaacttaagatgcgtcaggtccctgaagaaaacaccaaaatatcaatgggttaataattcaagacacaaaattgactgagtggtgtgtgtgtgtgtgtgtgtgtgtgtgtgtgtgtgtgtgtagtcttcaactatcttagattcaaagaaacaaaaaaatcttttgttggaatactgtcctacagagactagaagtatcatgctcttttcgattatgtctatttaaagggaacaatatggccgggcgcagtggctcacgcctgtaattccagcactttgggaggccgaggtgggcagatcacgaggtcaggagattgagaccacggtgaaaccccgtctctactaaaaatacaaaaaattagacaagcgtggtggcgggcgcctgtagtcccagctactcgggaggctgaggcaggagaatggcgtgaacccgggaggcggagcttgcagtgagcccagatcgtgccactgcactccagcctgggtgacagagctagactccatctcaaaaaaaaaaaaaaaaaaaaaaaaaaaaagaaaatgaaaaaagaaaaaaaaagagaacaatatattggggataatcaactagtcctgcaaccaagagacctgactttggatctcagcttagaatactagaacattaatgcttaggatactagaatatttttatttttgagacagagtctcgctctgttgcccaggctggagtgcaatggtgcgatctcagctctagaatattaaatgtgggcaagttgcccacatttgatgaatttcgggtttcttatttacaaaatagtagactggattcagtgatttatatgatccctttctgcattagatttcaattctacagaaccatgttggtactctcggtaaacttagataaatcttaaatgtttgggtaaatgtgtttggcccaaatgcatttacccaaacatttaaagttcatcttagtttactgagagtaccaacatggtaaacccccatcccatcgtgctaagaataaattctacatttgtttgtcataattttgaaatctatcttttttctcaagtcgcgtgcacattctggaggcttaaagtagccctagaaaacatggtagaggctctgtacccagtccttaagcacagatttcatctctgttgaactttcatggtcaatttaaatatgctgactctactgcttcactgataaacttggaccacaggaaagtacgtgtctgggcccattttacctgcatgccctgcataagtattcttactaaaatgccgctgtctctctggagatatgccgtatctacctattgccacagtgaactgctaagttttctgctatataaagatattccacctctttacagcctcaaggacagttgtccttcttcctttggatgatctcaaagggttacctatttttcccttcttcccttctgtatctaggaaatcttgtagctttcaaagcatttcaaatacagaggaaaatcttttaatcccagaaagtagcaactttttacggtaacacaaatctcccctgaagtaaataggaacaaatgttgactatcatcttgaagtagtggtagtagagtcactggagaaaacaaacacaaattaacgtttcaataaattatactgccacaactacaaatagttagctcttcaaaaaaatttattcatatgtcaacaaaatccttgtgctggagactccagtctctaatagctttagtgtctttaagggaacaatcacctgacatctatccctcaccatgcaaactctggaaagtttgctatactgtacaacctattagatcttacttgcaataaatcttaataaacttagagataaaaatgttgattttaaatggtaaattctaaatatatatatttacttggaggctgactgtatttccaaagatgttatttctgaatgttacttcagatcattcccaatcaccaaagagacgaccactatcctgaagttgtgtgaatcatctgtgttcatgttaccatacttaacacaaatgtattctaaaataaaacacacacaccttcagtgtatatactttttaaacttatatactttttgagactgattttttaaaagacacattatattataatccacccatggtatcgcacacacaaatatttaattcaatttagcaactgaataatatcatttttgagaatgtgccataatttatttctcaaattcctttaagatggccatttaagtaatgtctacttttttatgataaataatgctatatcaaagttattgaaagagaaaaaataaaataggaaaaacaatataaacaatgctacattaagattccaatgtgcatagtttctagtgtgcatgcgaaacaatttctttgatgatagagaggttgaattttctaaggttcttggcccattaaacttttttttttatggggtttgttgctcatttgtctactccattgcggaagtttttttttttcaaacacaatctattcatgtttttctttactgtttgtggtttttaatgttgtgtttaagaaaaccttctctaacctaatgttgtaaagctattttcatattttcttctaaaatgttaatattttacccttaatatttacattttctttcaatctggaaagattttgtgtgctttatagtaggttctgattcgtctttgttcatatggctttcctatgctctcaacatcatttattaaagggttcatcctttctctacaagtttgtaatttcacaacaatatttttcttaaatctatccaatctacataattttctgggctccatgttcagttcagttctctgtctgcaccttttttctgccaataccacgtggttttcattactatgactatttaaatatttatattaggttgaatagtttttttccttcataattattcttaaattcttcatatcttcctcaaaagttttttgccagttttgacttcctacttgtaattatcgacttggctgggccacagtacccatatagttggtcaaatatcattctaggtgtttctgtgaagttaatttttaagatgagattaacgtttaaatcagcagactctgagtaaagctgattaccctccataatgtgggagggcctcatccaatcagttgaaggtattaatagaagaaaactaatctccccctcaaaaaaaaaaaaaaaattctgcccacagactgccattggactctaattgtaacataaattcttctctgagtttctagcctgtctgtggctctctagttgttccagaaccatttgttgtaaaagctattctttccaccactgaatggttttgacaccttgtcaaaaatcagtttaccatagacatatggttttatttctggacttttgattctgttctataaatctatatatctatccttgtgtgagcataccactgccttgataattgccttgtagtacgttttgaaattaaaaagtgcgagtcctcctacaagctagaatctgttagtataatttattatttatttatttcctgtttgttctatttgttttactaattagtttatcttcccagcccaattcatttaattcttctgttgcaaatgtagttcattaatttttaaaatgatttctttcaaatattcatacataggtatacagaaagctagatagatacagattacaagtattgatttaaaggtttcctggaaggttttctttttcttttctaaataatatacttaataaattctaatactaattcttcattaaataatgaaaacaaagttcacaatataaaatatcaatgcagtaaaactaaaccactataaatatccaataactccaaaagaaggaaaataaaaatgaaagagtgttgacaagacaaataaaaagaaaaatagtttaaacaataaaaaaaatcagtaattacacttaatggaaatgaattagttgcttcaaataaaaagaaagtggcaggctatataaaattacatgtaactatatgttaccttcaaaagccatacccaaagaaagtggaagaaataaataattaataaaagaacagaaagtaatgacacagagaacaaaaaatagagattaaaaagccaacacttgcctcctataaacgactaataaaatcaacaatgtacttgagagactatatattaaacaaataaaaagcaataaggggtaaaacaaccaatatcagaaatataatgatgtcataaacatatatattaccatgtttacaaaaacaaaaatggagatacgtttacgaatacactttaaaacttttaaatatcacaattcactagaaacatacaacatcaaaatacatttaaaaagaaatagaaaattatatatacatttatacattatagaaattgagtcaacacgcaatcctctttctacgacaaacgcttaaatcccaaagagtttcaccagtgtgctctaataaacattcaaagatgaaataattccaatcctacacagactcttctgagaatagaaaaggaacactctccactttttcacttcgtattttcttaatttcaggaagaggaagaacagtacaagaaaagacaattacaagcattgccatccaagggaataaatggtaaacataatataagccagttgaatccatcattatattaaaagttaaattcacatcagaaagaaaaagttattttatactacaaaattaagggaagttactatgtaataaacaaattacataaaaagtatcttattgcttcaacagcagatacttgcacacacgtttaaagcagcacaattcacgattgcaaaaatatggacccagcccaaatgcccatcaatcaatgagtggataaagaaaattatgtgtatatatatatatatatatatatatatatatatatattacactgcttgagttatgggtgcatcaaaatctcagaaatccctgctaaagaacttgtgcgtgtaacaaaacaccacctgttccccaaaaacctattgaaataaaaattaaaaattgaaaaacataaatacaattttccaaatcagtggacaaaagataaaaaggcacacaaacacaaaaacaaaacccttagaaaatcttaccaaagtataatagaaatagaaaccttcttaatggaaaaaacaccatcaaacaataacatcacagttaatgttaagatgatttaagattcattttgaaatcagaaacaagacaagaatgccttctatcagcatttctatttagtgttgtactggatatcctagccagggcagaaagtcaagaaatagaaccaaaatgcccaaagattggaaaggaaaaaacacaactggtgctattcctatacaacattggtaagtactgagaaaatacagaataatctacaagaaattgctagtatttataagagaatttaataagatttctggataaaaatcaataaaaataaattgtagttttatataactgcaactaacagaaagtaaaattaaaaataaataaatcttttctgatggcacaaaaagttgaagcggtaataaatctaacaagatgtgtaaagtctctacagacaatattataatactttttcaatttgtacttgtcaattaaggaatgaatttttaaaaaggacgggtatagagacacagcaaacagacaagaatatgtataagcacttgtatggtggagtcatcgctgcagcttactaaagaaatcaacgatttgattaagaagtggtgagcgatagggtatccataaggaaaacatttataattaaaatttgacacttacttcacaccataaataaagttatttccaggtaacgacctaaatctgaaagattcacaaatatattttaaaagacaatttagaaggttagcttcatgccacacagtaaaaagttattttcctaagataggaaaagtacaatattttttttaaataatatatttaactacattaaattaagaaatattttccactagagaaaaccccaggtagttaaaaggcaagctatgcaacagagcgtgaaaaaatcattgtaactgataataccaataaagaccagctattcataatataaaagtactcttatacagcctgaagaaaaagacaacctaatttaaaaatggaaaaaatttcaacagatttttttacaatgacaaatttcaaaagtcaattgttaatgagatgggcattcatccttcccattgtcaatagataagtatatttaaatatcacaatctctttaatagacatgaaaactaaaattcaaaccataatgaagtgccattacataaccattagataggaggcattaacccatttatgcctgaggttgcaatgttttgaatttttccaatcagaccttggtgatgacttgagcagtaggatataaatagctcccacatggttagccttccaataatggaacactaggcataaatgggctaataagtgaaaataactaatgttgtcaaataatttaaatatgagaaacttccactgttgttcgaagtgaaaattgatttgaccccttgtgaaataccttgacattatcttgaggttaaggatatatttttttctgtgactcattcgattcccgaaacttccctgtgatgctgcgttccactaccaagggaaatgtgttctcataggcaccacgacacatatacaaaaatgggccgggcgcagtggctcacgcctgtaatcccagcatgttgagaggccgaggcgggtggatcatctgaggccaggagttcgagacaagcctgaccaatatggtgaatccccgtctctactaaaattacaaaaattagccgggcgtggtggcgtgtgcctgttgtcccagctacttgggagcctgaggcaggagaatcacttgaacccgggaggtgaaggttgcagtgagccgagatcagccactgcactccagcctgggcgacagagcgagattccatctcaaaaaaaaaaaaaaaaaaaatgtgcatagcagcattgttcatgacagccacaaattggaagcaatacacatacccatcaatagtattataggaatgcatgtataagtggtaaatttacaaagaaaagcagtgaattgattaacacacaagttaagtgagtggctatagattttattaagggaggattttgagatgatgcaaggcagagggaattccgaggtgttggcaacttcttatttcttgacctgtataatggtgatgtttgtttttacttcataattactcattaaatgtacatatattttatttagtttctatatactatcactaaacaaaacaaatattgtacctagggttctaagtacatgggaatgctgctacagaaaaatacttgtctccacagtgatgctggctggggcaacacccagggcaacaggataattgcctttcctaacaatctcatgtgaatgcatagtttgttgaatctttttcacatcaagatcccaaatcaaaagagagcctgggaattatttttaagtttactagagccggcaatttagaaaggcgcactagaaagtagacaaactagaccctgaatgtcaattataataccatctgaactcttcaaatatcattggttctttaagttggcttgttaatgagatgggcattcatccttcccattgtcaataaacaatatagtgcatatattcactgaactgtgtcacaactcacacctgctaagtgacattttcaaactgacttcgttaatttggtctagcatgtagagaaataatttctcttgctttaccagagcccttaaaactcccgaacccaatttcattatttacatacaactacacttccaaatcctcctataaatagccattctgtccattaaatacaggaaggagtttggttcaaaggttgctctgaagcattttcttaatggaaaaaatatttcatcagaaaaataaattttcattctcctcaggtttagtctttcaatgggcatcaagtaatattcactcttgcctcaaatctaaaacacacacataaacaacacacaaatcatccctgactacacaggccatgccactctctgaatctcggttttggcacatggtgaattaatgaatcatggtttgtttcctcaaactgctatagtgcacacaacacacacactcgcacagaccgattttctaagtcttttaaaatatcatcacacacaaataaatggaaaaactattccatgctcatggattggaaaaatcaatataataaaaatggccatactgcccaaagcaatttacaaatttagtgctattccctatcaaactactaatgtcacttttcacagaattagaagaaagttattttaaaattcatatggaaccaaaaaggagctcaagtagccaaagcaatcctaagcaaaaagaaccaagccagaagcatcacactacccaacttcaaactatacaataaagccacggtaagcaaaacagcttgatactggtacaaaaacagacacctagactaaaataacagattagaaaactcagaaataaagttgaacaccaacaaccatctgatggtcaacaaggctgacaaaaacaaccaatgggaaaaggactccctattcaataaatggtgctgggataactgcctagtcatatgcagaagattgaagcctcccttttaccatctacaaaaattaactcaaaatggattaaagatttaaatatgataactcaaactaaaaaatcccagaagataaccttggaaatactcttcttgacattggccttggcaaagaatttttggctaagtccccaaaagcaattgcaacaaaacaaaaatagacaagtggggcctaattaaagagcttctgcacagcaaaagaatcaacagatcaaagaggcaacctacagaattggagaagttattcacaaactatgcatctgacaaagaactaacatccagagtctatagggaacttaaatcaacaagcagaaaacaaccccattaaaaaatgggcaaaggacattaacagacacttttcagaagacataaaagtggccaaaaaacataaaaaaaattttcagcatcactaatcatcagagaagtgcaaatcaaaaccataaggagatagatatcatctcacaccggtcagaatggctattattaaaaagtcaaaaaataacagatgctggcaaggctgtggagaaaagggaacacttatacactgttcatgggaatgtaaattagttcagccactgtggaaagcattctggggatttctcaaagaaatgaaaacagtgctactattagatcagcaatcccattactgggtttatacctaaaaggaaataaaccatttaaccaaaaagacacatgcactcatatgttcatcactgtgctattcacaatagcgaaggcatggaatcaacccaggtacccatcaatggtagactggatgaagaaaatgtggtacatatacaccatggaatactttgcatccacaaaaacaataaaatcatgtcctttgcagcaacgtggatggagctggaggccataatcccaagcaaattaatgcaggaacagaaagtcaaataccacatgttctcacttaaaagtgggagctgtgcattgagcacacataaacataaatagtggaatagacactgtggactactagactgtctaggacaggggattgggctaaaaactacctatcaggtacgatactcactactagggtgatgggatctgtactccaaacctcagcgtcacacaatattcccatgtaacaaatctgcgcaggtactgcctgtatctacaataaaagttgatagcacaacaggaggactatagtgaatagtaatttaattgtacattatgaaataactaaaagagtataattagattattgtaacacaaagaataaatgcttgaggggacgaatacctcatttttcatgatggtattattacacattgtatgcctgtatcaaaacacctcatgtaccccaaaatatatatacctactaagtgccaacaaatattaaaaataaaaaataaataagtgataaaagttgaaattcaaataagtaaataaataaattgtaattacaattaaaagggaacacttttacactgctgactgaaatgtgaattaggacaaccattagggaaaacagtatggagattccttagagaactaaaggcagaactaccattcgccagcaatcccaccactgggtatctacccaatggtaaaaaagccattacataaaaagacacatacacacacatgtttatagcagcaaaattcataattgcaaagatatggaaccaacctaaatgcccatcgagggataatgagaggatcaataaaatccgctgtatatacaccatagaatactactcagccataaaaaggaacaaaatagtgtcatttgcagcaacttggatgaagctggaggccattcttctaagtgaaataactcaggaatgaaaaccaaatattgtatgtttttacttataagtgagagctgagctatgaggaggcaaaggcataaaaccgataaaatgcgctttggggcctcaggagggaaggttggaaggagggtgagggataaaagactacacattgaataccgtgtacactgctcaggtgacaggtgcactaaaatctcagaaattgccactaacaaaattaatccatgtaactgaaaaccacctgtactccaaaagctaatttaaaaaaaacctctaaatacaaaaaaaatcaaaaaatgaaatgaaatgaaatatcatcgtaattgaataagcttacaatcttgttataactaagatgtcatgacaagatttcctagtatggtaccataaaccatcaatctcagatgactcaatcattctgaaaatctctacaaaatatagcattctacagtcgtagttccccttttgcacagctcctacccggctcatagagaagagaattttttgtgaataagttataacttctctttaaacatcctttccatttttaggctacttgagatttcataaatttaaagctgttaatacaatgaagtcaaatcttaccttgatatctgattatgtgctagcaaagattattgattatttttaatatgggataaattcataattacccttgaaaacctcttaaatcaatcataatatacaatgtcaactaaatcatttttatcagtttctctaaagcttctttagtcaatttcctttacccatggctcccaattagctctttaattaattatttgaagctggcagggaatcacaaacccctaaacaatgtatttttcttcttctcattggtacctaataggttttcttttcactagtttcaagccaggtttcaaatgaagctggaattaaatactgtatcaaatacagtggcccctccaattttgccatatcattcagggatctttcctcccttttcatagacaatctaattttccttttagaatccaccttgaatgatgcagacacaaaaaccaccttctttaaatttctttccactattcatactttgcccaataacacctagtgaaaaattcctatagaaatgaataacctcatgaaaattattaacttgtgcattcaggttaagccatgcattctcaaactcgacagtcagtgcttccatgtcaagattactgcttttctcatgttaccctcctgctgaaagagtgttcattacatcaatctgcagaaactgtgtgcactccccttcctcagtaacaatctggtaagtagtttagatgaatgatggagtgtttcttggctgatttctatgctattctttgatggaggcacggccatatgttatgtcacagtagaataatctcagacaagcccacaaatacataaatccttagttacatagattttaatgtctggaagagcatgaaattgtttctgttactagaagaaaacactactttacaaatacaagacacatagagattagcagttgacacagacaattctttcttttttatccgtttaaaatccatacagtttatctttaatggcatctctgaaggtttatgctaattttccacttcttccacagtgaccttattttctttgtcactcttctctctcttcaaggtcattgttatcagaaaataggctccattcttctttattttcagccgtctaggtatgtgggtaagcatattgtgggagaccctacaaactgcttcccctgaagaccctatgaaataatctttagatctttcagctaaacatctataatcaaaatttctcttggaaacatcaaaagccattagttgatgttatgataatagacatttttctctcttttcttatgttagctgaagctctcttctaggaaggggaatgaggaaagagtagttaaagtagggagcaatcttaccttactgcataaaattggggagatagacgagcactatgtggcacttttctatttttttatttttatttattttattattttttttttttttttgagacggggtcttgctctgtcaccaggttggagtgcagtggcatgatctcggctcactgcagactccgcctcctgggttcaagctattttcctgcctcagcctcctgaatagctgggactacagacacgtgccaccacgcccagcaaatttttgtatttttagtagagacagggttttatcatgttggccaggatagtctcgatctcctgacttcgtgatccaccctcctcggcctcccaaagttctgggattaaaggcgtgagccaccatgctcggcccggcactttttctgtaggaggtgatggcacaacaatttagtattcttataagagaagtggaatttttaaaatattattacttttttaaggtagagagaatgtacctccataataatgctttctgactttttactttatttcttaacttctgaaccctaaagctattcaggcactgtttttatggtagttctggaactatcagatagtaggagaaattatagatctttctccaaagtcaaaagtcagtttactaaccagaggcacaatttaaagactttttccttcaaataaatcaaatccctgtagtctttaactcaaaaaatcccttacctccattgttaatttgcgaagataaaattttaaagttcactgagctatattttccacctaaattatgtacaggttgagcatccttaatctgaatgaaaatctaaaattcaaaatgctccaaaatttaaagctttttgagcatcaacatgacacctcaagtaaaaagttccacacctgacctcatacgatgggtcacagttaatacacaggtacacaacacacggtttattcagcttccccaagggaaaaatgattctgccagccatttaaaaaagacattcaatagaatgcctcttcctgcctagatgcttctggggccccactactgcttctgaggtttcttctcacctagaaaaataagatagagtgtacagtaactttttagtaaaaacacagcattgtatgtggagactgaaaacttgccattgtttgttgttgctgttgttgaacagttgatacaggtattctggtaatgctactgtgctgcttagttatccccaaaacattatgtttttaccgtattaatagtatatcattttgtattgtcaagtatttatatgtgaataattgtaaagaaatgaatgcttatgagtagcatataaattcagagtcaggaatgatggtaatgccaaaaaaacagattttccacatgggtgactgcaataatgacacctttgcttccagatgcttcaacatatacaaactttgtttcatgcacaaaattattaaaagtataaaactatcatcaggatatgtttatgtctacatggaacataagtaaatttaatctttagacttgagtctcatcccaagatatctcattatgtatatgcaaatgtttcccaatctggaaaaatccaaaacctgaaacacttctggtctcaagcattttggaaattggatactcaatctgtattccattaaaataaaaggataagggatactaaataggccaagatcctctcatgtcatgtaatgtcttccaacaaaagtaattgtgataactacaatgccatatttgttatcaactatgtgtctgttacaaaatatactattggaagaccaggttaatgatacatactttgagaaattccaagctaaagaatttatttaagtaaacatgcaaacacttcatttatttttattatgttattatagtttttagacagcttttcaagccaacatctccaagaagctacaaagtttcgcacatgttctcctctaagtacctgttctgattgattataaacctcagtgctgatgaataaaaggaaagactgtattcctatgacttcagtctgcccattggtgattgagacaggacccttgtcctgtcactccagtgtcagtggtctctgctaatgtgggatgagttccctgtgtgacctcagcatgggaaggggccatggttaattcatatctttgcctcttttaccatggaaaaccttcaaaatagaagccacatcttcaaccactgccagcagtaaccccattcaactcattttctgggttatgatcacagtaactcagagaaagagtcggactcagataatgagtcagagagggttactgctagcagtggctgaggatgcgacttcagtcctcttttaagctgagtttgaaagtgacctgaaggtttggtactactattatctcttacccagaaaaatcatttcttctaccatgtcttatctgctattaagcacattcagtgatttttttaaaatctcagacacttaaaatttggctaatagcaactctattgggtcttttttctgtattttccagatttctgcttaaattttttaacatatggagtacaattatgatagctattttaatttccttatcttctacttctaacatctgtgtcagatatgggtttcttttgagtgattgattgttctcctcattatagctcatattttctggtctttttatacctggtattctttggtttgacaccataaattatgaatttcaccttgtggtggtgctgaatgttttttattccaataaatattattgagttttgtttcaggacatatttaagtcatttggaaaagttttaatcttttggaatcttgcctttaagatttgttttgctctcaaaaactctgtcagctaagtgttttaatatttactttatagattataaaaattaaatgtatagagattatgtaaaagtcatatacttgtatgtgataggttctcaaaaattgtcattaaagaaatagaattcaaatccctatgattctaaagacaccatgctgtcactcttactattttccatctgtttttaatgaattcacttattaatcagatgaaaagtcccttaaagatatcttaaatacaaaatgtgaataccacgctaaacaataacatataacagttttcttaccactgactctgtaacaattcagtattctaatctggtctttctatttaacactaactatatattgttataatatgtaaaaaatatacagctaaaatttatattgaaaataatctttgtttttatattttgatattataaaaatgtttcactatgttgcaaatagccagactattctaaaatacttattttcagtgatgtcttaaatccttattttccattaataataaataaggcaaacagctgactacaccactgatccaaaaggatgatttggcagttcctgcctcagagattatgttcattttcatgtttatattttatttaatttactttggaagaaatgctttcattttcctctttgtaactagaataatccccattatgaattcaaaacagtagcagtaaaaaacaaaggcttattttatttaaagccagaaataatcaagttataacaatgcactcattcactcacccctgcacacacacatgcatgcgtatctacatacatagacacacacacacacgtgtgtatgtgtgtgcacgtatgcatatatgcatgtgtgtggtgcatatatatgtgtgtagtgtgtgggtgtatgggtgtatgtgtgtaaaaatgtaaaattctgacttatgtggtatatattcattaataaactctaatggatagtccttactctttgttttggtcacccaatctatgaaccaatacaacacttatggaaaacctcactttatgagacagaacctgtctgtccttatagaggctgaaaatgccagctacttgatttctgagcatccctgaaagctatggtctagcatgtgactgtggctctgtcaatcaatttttttttcccctctggagagtggactagaagctattaataagaataaaaaactgctcagaatctattctagcgatagaaagcagaagctactttcagtatgcagaagaagcctatcagtgattcaaatgatggtatttagtgacccatttaattattatttgtagttccagctatagtgtgtctgcccagggattctagcagtaagttgtttcctggaacaattccacagtgtgattactgggcataattttaagctgttcaactccagtcctgattcttgaacctttcagatattttagatattctagaaactgcccaatatcgttttagtaagtttaatttctgtgtgactaagccacagtaagtcatgattattctgactgacataaaacttgatactagaagagatcaaagacaatagatccttaaggaaaggggggaaatcacctctttccctaaaaaagaaaattgttatatagccaggttggcactgaaggaagtaaatctccacttaataataaagaatgagactctagcattctgtaccacagaatgagaaacaaattcatgaaattatccttggtgtctcttggaattgagtgtttgttaatgatttgactaaagaaatccaagtagtggctgtcctataaaagtataaaggtcacgagtattccaaatctgtaggatagcatagttgcttgaaaaggcattgagatttgtaaatacaatgagaatgtcatgctcacgtcataatttcctttcaaggcagtattgaaatataattgactttcttttaaaattttttaattttttatttctgtgggtacataataggtgtatatatttgtgcggtacatgagatattttgatataggcatgttatgtgaaataatcacatcatggagaatggagtatccttcccttcaagcatttatcctttgagttaaaaacaatccaattacactctttaagttatttttaaatgtacaattaagaacatgtgaagtttgtatttctcttccaggcttatttcacttaacataatgatctccagctccatccatgttgttgtaaattgctagatctcattgtttttatggctgaatagtactccattgtgtatattcaccatactttctttatccattcatctgttgatggaaacttaggtttcttccaaatctcaaacgtctccctggttaacactctcagaagaaggcctcctggtttctaacacccagatttcatggagagcacaatctctcacaaaaattttattcaatatttatgaagaaaaaatatatttatactctcaaaatgcaatatattattaacaaacaagatgccattttacaatatttatagaaatgccttaagcatttaatggttaacataatatttgttacttacatgtagttttttatggcactttggtaataaattatttaggaatttgagttgacatgaaacacaaaacactttttatttaaaaaaaataaaataggcccctcattattttcaggcaaaatatctgattttaaggaacagattactaatgctaaatgagagatgacttaagtggcttttcctcttttcttcctttatactttctctctatttttatggagatacttaatgatagttaaaatttaaattttgtacataggttatagaatatcaaaaatatatatctgggtcaggtgcagtggctcatgcctgtaatcccagcactttgagaggctgaggcaggtggatcacctgaggtcaggagtttgagaccagcctggccaacatggtgaaaccccatctccactaaacacacacagacacacacacacacagacacacacacacacacacacacacacacacacacactcacacacacacacacacacaaaatagccaggagtggtggcaggtgcctgtaatcccagccactcgggaggctgaggctagagagttgcttgaacccaggaagcgaaggttgcagtgagctgagatcggacaactgccctccagcttgggcaacgagcgaaactccatctcaaaaaaaaaaaaaaaaaagatatatgacagaaatacagtagagtagatgtacttttcatctaaagaacctgggcgtgaagctggatacagtaaataatgagcattttgcgtacagtccagttgttctcaagcagagacagttttaacccccagagatatctggcaatgtttggagatatttttgattgtaacaactggggaagaggtgctactgacatctagtgggtagatgagagggatactgctaaacatcctacactgcaggacagcccctcacagcaaagaattatctggaccaaatgtcaatagtgctgtggtgagaaaccctgatctgatcttgtatgaagatagaccatttacatttcagaaggatacctacaaataatattatttctctttaatagaggtgaagaaatagaaaacaaaagctgcgtgtttatgtgctagtgcaagaggtaaactctaaagaatgtttgctactattttggccactcagcataaccattctctatgttttaggaatctcccaatttattaggcaaattgtccttccactatagaagctaaagatcccaaatacttgttttctccgcctcttttgaacctagggccaaagcaccagaattgggttctatcaatttcatgcacgttcttcagatttggaattagaagctgccagtgatgtggaaaagtacaattgtaaaatctgttctggtcacacaaaaaaggaatagtggaaacaatatccactttccaaaagcagcagcatctaatgcccagtgtttgcaagttcagcattacactctgcagagtaatcaagtacagtcatgccctgcgtaacaacttttcagtcagcgatggaacacagatacgactttgctcccataaggtttccatcacctagtaacgtgttgatgctgacactgtgcatgcctgggctaatgtgtttgtttgtatcttagttttttaacaaaagtttaaaaagttaaataaaaaaaaaaaacttaactagaaaagaggagacagcagggaggtgtgcccataatcccagctacttgggaggctgaggcaaaaggattgcttgagcccaggagatagagacaaatctggcaacatagcaagactcccatctctaaaaaatatgtataataaagaagaaagttttaaaggaaaaaaataaaatagaaaagagcatatggaataataatataaaaatatttttgtgcaactgtacaatagttggattttaagctaagtattactacgtaagaaccacaaagttaaaatatttaaaagtttataaagtaaaaatgttacagtaagctaaggttaatttatgatgagaaaataaacctttctataagtcatgagtagcctaagtgtacagtgtttacaaagtctacagtagtatacaataatgtcctaggccttttcattcactcaccactcaatgtctcactcagtgcaacttccagtcctgcaagctctattcatggtaagtgcatataggtgtagcatttttaatcatttatactgcatttttactgtacattttctatatttacatatgcaaatatttagcattgttttctaattgcctgaagtattctgtacagtaacatgtgtatagagttatagcctgggagcaataggctagaccatatagcttaggtgtgcagtaggctatgctgtctaggtgtgtataagtacactatgttgttcgtaaaatgatgatattctctaacgatgcatttctcagaacgtatcctcatcattaagcaatgcacgactgtatttatttccttcttaatgctgtcaaagtcaaatcacgttgcttaaaactaagagttctttctgttaaaatcaattatcacttagtgagctccatccattggcgttgtcaaaatgtagaggaggctatataaataagacacaggctctgttagtgaccttgcttgtaggggaaatgtactgggtgttatagtacatacatgttcaaggagctattgggatacagctggaattttttcttgtgctcattttgatttcttctttaatttgtggattatttaagtaaattgcctaattcttaaacatttggagatgttttagttattcttgttactaatttctaattcaatatctcaacagtcaaaatatgtttaatgctaatctttaaaacatgttgaggcatgcttaaattacagtcatataatgaattttgggccatggtctatatgtacttgaaaagtgatttctatctttgttgagcagagtgttttgtatatttccatttgatcaaacttgatatttgtgttaaaaatcttctatgggcttttgactaatttttcttcctattactgagaaaattgcgttaaaatttttcactatgactgtggatttatctatttgtttcttattttctgtcagtttttgctgtatgagcttttgaagaacattactatttgtatgaaaatttagaattattacattgttttagaagactgatcctttaatcattatgatatgtgaaatatattctgctggtacgccattagaattaataacataatttaacaaggttgctaaataccaagtcaataagaaaaaaaatcacttttacttgtatacatcaatagcaaacaggaaattacatttttttaaatgatgctcttggcagtaacatctaaaaaaatgaaatggatcagaaaatatctaatgagaccccctacattaaaaaccataaaacattactgagaaaaattaaagaatactgtattagtctgttttcagtcagctgataaagacttatccaagactgggaaatttacaaaagaaagaggtgtgctgacagttccacgtggctggagaaacctcacaatcatggtggaaggtgaaaggcatgtctcacatggcagcagacaagagaagagatcttgtgcagagaatctcccatttttaaaaccatcagatcttgtgagacttattcactatcacgagaacagcataggaaagaccagctcccatgattcaattacctccaaccagattccttccacgacacatgggaattgtgcaagttacaattcaagatgagatttgggtgggaacacagccaaaccatatcattctgcccctggcccctcccaaatatcttgtcctcacatttcaaaatcaatcatgccttcccaacaaacccccaaagtctcaactcatttcagcatttcaaaagtccacatttcaaaagtccacagtccaaaggctcatctgagacaagccaagtcccttctacctatgagccagtaaaataaaaaacaagttagttacttcctagatacaacggagtacaggcattgggtaaatacagccattccaaatgggagaaattcgccaaaacaaaggggctacaggccccatgcaagtccaaaatccagtgaggcagtcaaatcttaaagctctaaagtgatctctttgacttaatgtctcacatccaggtcatgctgatgcaagaggtaggctcccacagccttgggaagctcccctgtggttttgcagggtatagcccccctcctggctgcttttatgggctggcattgactgtctgtggcttttccaggcacatggtgcaatctaccattctggggtctggaggatagtagctctcttctcatagctccactaagcagtgcccctgtggggactctgcgtaggggatcccacccctgcgtttcccttctgcactgccctagcaaaggtcctccatgagcacctcgcccctgcagcaaacttctgcctggacattcaggtgtttccatacatcctctgaaatctaggcagaggttcccaaaccccaattcttgactccatgcacttgcaagctcaacaccatatggaagccaccaaggcttgggacttgcatcctctgaagccacagcccaagctctatgttggcccctttcaggcacagctggagtggctgggtcccagggcaccaagtcccttggctgcacacagcatgggaaccctaggtccagcccgcaaaaccactttttcttcctaggcctaggggcctgtgatgggaggggctgtcgtgaagacctctgacatgccctggagacattttccccattactttggggattaacattaggcttctctttacttatgcaaatttctgcaactggcttgaatttctcttcacaaaatggatttttcttttctattgcattgtcaggctgcaaattttctgatcttttatgctctacttcccttttaaaactgaatgcttttacagcacccaagacacctcttgaatgctttgcttcttagaaattttttccaccagatattctaaatcaactcccacaaattcaaagttccacaaatctccaggccaggggcaaaatgccacaagtctctttgctaaaagtaagaagagtcaccttatctctagtttccaacaaattcctcatctctatctgagaccacctcagcctaaattcattgtctatatcattatcagtattttggtcaaagccattcaacaactctgggagttctaaactttcccacgttttcctgttttcttctgagccctccaaactgttccaacctctgcctgttacccagtcccaattcgcttccacatattcggttatcttttcagcagtgccacactctactggtacaaatttactgtattagtccattttcatgctgctgataaagacttacttgagactgggcaatttacaagagaaagaggtttattgaacttacagttccacgtggctggggagactgcacaatcatggcggaaggtaaaaggcatgtctcacatggtaggagacaagagaagagagctcgtgcagggaaattctcagttataaaaccatcagatctcctgagacttattcactatcataagaacagcacaggaaagagccccccgcccgtgattcaattacctcccaccaggttccctccacaacacatgggaattgtgggagttacaattcaagatgagatttgggtggggacacagccaaaccatatcaaataccttagtaaattaaggaatatacaatgttcatgaaatgaggaactcagtttattaaagagatcaatatcccacagattagcctaagttacaatgtaatcaaccaaatttcatttttttcttttaagttttgtgttttgctgttgtattttttgtctttttgcttatttattttttgtttctttgtggacatttacaatggttttagaagcacgggaaagtctgccctcctacaatagaaaattgccactttctctctcattgatgttgaaatcccacatttaaatattcactgtacaattttactttcctttgctcctcttttagtggcactcctccatctctctgggagatccaacacttgagggcttatgagccgtttcagtatgaatgaaagggagaagaacagaacagaggtaagaggcatcgagaagggtaaagaaaaatgagatcaataaagacaaccacaggctatacagagacaggcctttttctatttctcagtcctacttggagaagctctgtttaacaaaatttagaaaagccaatgggcaaagtatttctgcttactgctttattgtctatcccagtgtaagccagaaaatgaattagtcaccacctgtttaattaaaaaaattaatttaacactttaaatttttaaataaaagttgaaaaataaaaatcatatctttcttttttagttgatatatcatctggattccaaaacatgatattctgttttctttgggacataagaataaatgttttgatgtttgtgactatgtgattaatttgccacatggactgggaacaaaaagatttcaatacttcttaatatttaaagttcaaccatttgtctttgataaaatgctgagctcagcagttcatatttttctcatttgtaagatagagggactgaaatagctcatgaatgggttctcttttactcctttaagagtacatgactctaagtcagatgttcatttgattattcaggaaatactttatgaataatgcaagataattatatatgactcttctcttttatacatagcaattttttttctaaattttttcagtgaaggagtagatgtaagtatctattttgctagaaatgaggattacagcaaagtctaaggtttcacttagtttaaaaagttgaagataaaagagtgaatattgttaatatcaacattatttagaaaataggttttacatctcacagattccattcagaaactcataatgttttaaatcatccagaaatgctcgaagggcagacaacttattctgtgtgtgacacttataataacacaaaactttgatttcttaaatatgatttctaactcaaactcctttatttactctggcaaaacatataaaaataaaacaaagttaaattaagtgaccaaaaaagatgtaaattgcctgtgttagataatatttaaaatataacttcctgatgttagaatgccctaacttgagaaaggtgtctgaatctgctataaagaaatacctgaggcttggtaatttataaagaaaagggatttattttgctcactgttcttcaggctataaagcatggcttcagcatctgcttctgctgagagcctcagaaagcttccggctatggcagaaagtgaaggtcagcaagcatcacatggtaagggggaaggaaaaagagaggggcgggaggtgccagacttttctaagcaaccagatctcacatgaactaatagagcaacaagcaataactcactaattaccaaggaaagggcaccaagccattcatgagggatcctcccccattaccaaacatctccctttaggccccacctccaaaattagggatcaaatttcatcacgagatttggacgggacaaaaatccaaactatatcaacaggcaaattagtagatgaattatttaaaagcttgctatctctacagtttgatgcttttagataggatttaatcaatcaacaaatagttatatccaaagttacttagactagtggtctttaaattgtggttcttggaattttgagatttttcacaaggagatttagaaatttaccaaagaggtagggatacaaataaccaaagcagcatttatttaaaagtttgcaaattcattggattacatataaaatttcgatttaaaggtggaatatgttgctgtaaacatttggataccactgatttatgcgtaaacaatattttcaattatatagattaataaggtaattgattaaaaataatatctattgtatattgggcatttattaaatcccaggcactgtttgagtgcttaaggtgcactaacttacttcatcctaacaccaatccagtggtcattatctatattttacagatgtagaaatgaagacactggacaattaaataactgttccaattagtaaataaagaaaccatgaccaaactcagactatttagctccagagtgttcacttttacctatgacagtaatttactttcttaggacctccttaggataatggacatttttgaaagctagacaaaagtgagaaagtagaataaattgggtttctgttcagaaaaacagcactacaaaagtggcattaaaatattcatctagtaatgaatgtaggataaatatatgatagcagagcctaggtttgggtatttgggcttattcattcattcactcattggacaaatactcaatgagccagtcactctcatttgcacttaggttacgttgatgaacaaagcatacagaaaattctgtcctcttggaccttgccttctaatggaaacagagactagagtagtttcctgggcttaagggcctggcctaggaagttagcaataagcctgtgaagtaaagaataggttaaaactatttaaacaatttttttgtacctaaaagttatgacaatggtagaaggatgggaaaatcagaaaggaggactagttttggaaaaatgaattgttttgaatagctgattttgaagaaatagcaagacatccatttgtaaatatttagaaggcagttagcaatagaaagctgagctttagtgagattaaactacatagataccagagtcattaacattattattaggtaatattcatcccaatggcaagttttagttggaatcacaaaatcgaataatattcttatggagaaggaaagtcagcaagccaaacactgaagatttgtgaattctcaaaataataggaaaggagaagtaaaaaagatgcattcaaagtaacaaactgatttgctgaatatgtaagaggagtaacaaggtagaatatagtcacaattcaatgtaaatgtaacagtcaactacagtcaataaaatatcaaaagcaatggggattttaaaataaatgagtcagaaggaaaaccttttatttgggaatcctaaagacattattgatgttcaaaataaaatcttgctagaatgttgaatgaaatcagggtaaaatgagaaaaaaaaatgcataaatgccacttgttttacacatatcctagtacaagctaggggagaagtagattattaggaagaaagatctcttttattttggtagtaagggcatcaagaacagaaaagtatttggaaaccacaaataagctgatgattacagaaaacattacttagcttttaaaaagctgtgaaacaaatagcttactaagatgcagactaattccttagtctttccactactatatgctactaccaagagagtaacagaaatctgtcacatatttataacaatgcttgctcattttcccagcaattttttcttaatctactgccttttgcttccttgacttggcaatacaataggattttagtgcagggacaatagagcaataatgctagactcatttataatccaaacttttcaaacattttcccacatgaaaagcagttaggattaattaaaaagaaagcaaagtgataaataagaaatcttcctcttataaagacttttaaaaacctttgttctgaaaagcagatatgaatcactgacagcatacattcagatattagctaggtgcactcaagctttcttccagggtaattctgccccctacagtcttatcaaatgaatgaaggtgactttagcttgaaagaaatctgctaagtctctgatttaggcaggaagacaatatttggttcataaaatatccctgacctattaaatttgaggaccctctaacataaaaggtaacttcacagaatttaacaagtgggcatatgagtggctgtgtgataaccactggaaaacaaaattaagttttatgaaaatctaattttgttctctagtactgaaaacattattggtgacaatgttgaattttaccaaagcccaataattctggaaactagcaaagattaggaaattctcctgccttttgttaccccaaaatagcttattgcaaagatctatccttcccagtagataagattcagggatgcctccccttgttttactatgacatggtcaaacaaagatcctccaaattcgcatattttgcctcataaattattaactgaattgcttggccctactgatcaatcagaaaaaaaaactgcttgccaagtttctctttccttcatgcccctgaactctgacccaccattaacctgagccaaaccataaaccttccggagaacaggctggcctcagagtaaaacatttgatctaggatctgatcgagtgaccctttaatcttacttcctctgttgtttctagctttgtctactccttcctattgaagaacagccctttttgcctaaactttgagatgcttgcaggtattacgatcagagctttatccctattgtgatagttctcctccccctattgcaacagacgttcacccctactttgcaataatcttttcaaataaagtctctccttactaagttgagatttcttttcacttgacatttgacaactagtagaaggaagtaaatattgctgcatttagatatatgtgattgttgagaattgaagactctaagtactaatttgatgtatttagtgaattataagtgttaaataatataacagagtgcacgaagatatatatatttaagcatctgctatgtgcaaaggtatcttctaccaggacacaattaaacaaatccatttgttcagaaagcacatacgttagtgcagaagactacaataaaatcatcatgagatgagttgacggaaatatacacaaaatgttatgcaaacatttgataaagtcatttattttgaatgcctagcgtgggtagcaggaaaataatgtgacaggaaaagttttacaatggaggtgatatctgagaagagcattaaatgttgagacatagggttttgttagatgagcaaactgtgaataagctgcatttggcattgggaacaaagtgatcacagaaaaaacaagatataacatggcttgtctggatagtaaaagtaattggaattgatgcaattgtagagcatgaatgcaaaacaattgaaggggagctggaaagatgagcaaacacaaagcagccttttacaaaactatgcagaatgggcactgcacaactccaaggagtgtcattcatattgatgtcaatttgaatggctcttcctggagttgtgtatagccatatgcaataattaatagagtatttttatgctaagtgtatatggtaagatgagtctggtagcaaataacagaaaccaaatctgtctgccttcagattcaaggggattaatgggaaggacatcagaggttcatgacaatgatatggggctggaggagagccagggcattttggcaggttacagaacaggaagttagagagccaacttttagcaggagcaatttggccagagtgctactgactgaggtacagggtactaccaacatcattgctgtgaaataattgtagccatctctcattgttgcagtattttgttctatattcaatcttctaggtgagaagcctctcaccaagcctgagctgggctcttctcaatggaaagtctacagagtagagattatcctcaaaattgtaaggaggtactggacatgaacaaccaaacatgagaaatatttttgaacatgacctaaagcttagactttattttctaaggaaggaattggcaaacattctcttaaaggatcagatagtaaatagtttaggcttgccagccatatggtctctgtggcatctaatcaattcttgaaagcagctatgcacaataccaaatcaatgggcatgattatgttctaataacactttgtttaccaaataggtggtctgactactggtattagcttgctaaagacccctgttctcagagatgtgaaggctttacagagttgcaagtctttgtcatatgtaatcagttggccctttcctctatgactagatgaggtggcagctatgaaaggaacaaaaagtcatagtctgtgttcttaataaagttatacagtaatagatgaggccaaaataaaatatacaataattgtaatactttattgcacataataacaaaattaatttggaagtattcacattttctcatcttgcccccaaattgtagaattacaaatctagtttagcccaggaccagatggattcacagccgaattctaccacaaattcaaagaagagctggtaccattccttctgaaaatattccaaacaattgaaaaggggggactcctccctaactcattttatgaagccagcatcatcctgataccaaaaccgggaagagacacaacaaataagaaaacttcaggccaatatccttgatgaacattgatgagaaaatcctcaataaaaaactggcaaaccgaatccagcagcccatcaaaaaacttatccaccacaatcaagttggcttcatccctgggatgcaaggctggttaaacatatgcaaatcaataaacataattcatcatataaacagaaccaaagacaaaaaccacaggattatcttaatagatgcagaaaaggcctttgatacaattcgacattccttcatgttaaaaactctcaataaactaggcattgatggaacacatttcaaaataataagagctgcttatgacaaacccagaaccaatatcatattgaataggcaaaagctgaaatcattccctttgaaaaccagcacaagacaaggatgccctctctcaccgctcctattcaacatattattggaagttctgggcaagagaaagaaatagagtattcaaataggaagagaggaagtcatgttgcatctgtttgcaggtgacatgatattatatttagaaaaccccatcatctcagccagaaaacttcttgaaatgataagcaacttcagcaaagtctcaggatgcaaaatcaacgtgcaaaaatcacaagcattctcttacaccaacaataggcaagcagaaagccaaatcacgaatgaactcccattcacaatccctacaaagagaataaaatacctaggaatagagctaacaaggaatgtgaaggacctcttcaagaagaactacaaaccactgctcaaggaaataagagaaggcacaaacaaatggaaaaacattccaccctcatggacaggaagaatcaatatcatgaaaatggttatactggccaaagtaatttatagattcaatgcaattctcatcaaactaccactgacattcttcacagaattagacaaaaactattttaactttcatgtggaatcaaagaagacccgtatagccaaggcgatcctaaacaaaaagaacaaagcaggaggcatcacactacctgacttcaaactatactacaatgctacagtagccaaaacagcatggtactggtaccaaaacagacatatggaccaatggagcagaacagagacctcagaaagaacaccacacatctacaaccatctgatctttgataaacctgacaaaaacaagcaatggggaaaggatctcctattcagaaaatggtgctgggaaaactggctagtcatatgcagaaaactgaaactggacccgttccttacaccttgtacaaaaattaactcaagatagattaaagacttaaatgtaaaacccaaaaccataaaaaccctacaagaaaacctaggcaataccattcaggatgtaggcatgggcaaagacttcatgacacaaacaccaaaaacaattgcaacaaaagccaaaattgacaaatggaatctaattaaactaaagagcttctgcacagcaaaaggaactagcatcagagagaacaggcaacatacagaatgggagaaattttttgcaatctacccacctgatgaaggtctaatatccagaatttacaaggaacttaaacacatttacaggaaaaaaaaacaaccccatcaaaaagtggacaaaggatatgagcagacacttctcaaaagaagacatttacacagacaacaaacatataaaaaatgctcaacagcactgatcatcagagaaatgcaaatcaaaaccacaaagagacaccatcttacgccaatcagaatagcgattattgaaaactcaagaaacaacagatgctggcgaggctgtggagaaataggaactcttttacacggttggtgggaatgtaaagtatttcaaccattgtggaagacagtatggcgattcctcaaggatctagaaccagaaataccatttgacccagcaatcccattactgagtatatacccaaaggaatataaatcatgctactataaagataaatgcacatgtatgtttattacagcactgtttacaatagcaaagacatggaagcaacctaaatgcccatcaataatgagaccggataaagaaaatgtggtacatatacatcatggaatactatgcagccataaaaaggaatgagatcatgtccttttcaggggcatggatgaagctggaagccatcatcctcagcaaactaacacaggaacagaaaaccaaacaccgcacgttctcactcataagtgggagttgaacattgagaacatgaacacagagaggggaacaacacacaccagggcctagtagggggtaaagggtgaggggagggaatttataggatgggtcaataggtgcagcaagccaccatggcacacatatacctatgtaacaaacctgcacgtttccccactttttttttagaagaaataaagaaaataaataaactgtggcttggagatatgtttgccacaatggagttttcatttaaggaagtctgcctgtatcctacaccaagcatgtaatacaactcatattcatagaaattgtcattaaagcataatcacagtggaaaatcaacaactcatcacccactctctaaaaccttctctccagtatcctctccttgtgttcctttcacttacccaagtacttcactatgtaaagttcctctaagaacagagtttaaggcatggccatcacaaagttgagtgtgaacaataggtgagatccctaatgaatagttatactccctttaagaagtctaaacaattcctagaatcaagtggaagaaaaaaggtttggcttatcttctcttaaaaatgtcttaaagatccagtccatacagtttccatatggttgaaagcaggttgatttgaagagggaactatgggtttttatggggtttttgtttgttgtttggtgtgtgtgcctgcatgtgcaatgatgttctcatttgtgtgtgtgtttcaatttaaccaatgttgaggaaaaacataggaagattgaaactgcagtggtcccagaagcatgcctttaaagtcgtatttttgtcaatctctagacttgagacttttttttttttgacagagtttcgctcttgtcgcccaggctggagtgcaatggcgcgatcttggctcactgcaacctccgcctcccagattcaagtgattctcctgcctcagcctcccaaagtagctgagattacaggcacctgccaccacgcccagctaatttttttttgtattttgagttgagaaggagttttgccatgttggcaggctggtcttgaactcctgacctcaggtgatccaaccccccttggcctcccaaagtgctgggattacagcagtgagccaccgcacctggccgacttgagacttttaaaagctcaccaagctactcaattactgtttttcacatttgaaaaataaatgaagctttttctaactttaaagttatatgataatatggtcattttcagttttaactctttaataaagattccccatctaaactcttatttatttctaaattcctatgagtaagtagatagttgattatttgaaactttcactgattgggtcctttccactcaaataaagccaactgatccacagaaatatacttaaaccgtccagaaggcagatctaaatgtctccctacaatcattgtataataatatatctttaataaaattctctgtaaaattgattactaggaggtcttaagtgtttcacaagcctaaatatgttaattaaagaagtaaaatgtgtgtttcattgtttggtttttatatgttttatttttattaagctatttgctagaaaaaatatgtttctacaaatagtgtgcacaccataccgtgcatcaaaagtggaagttattttggcaagaacagaatcctcattagcagttagcacttcccagtaaattttcaataatattaaaattagctatggatgcatttatgatactgtctttgttcaccttttataacttaaagccactagaaattgttttcaaaatatatatataaatattcatgaattactttattagtatttttcataactgaaagatctgtctcaagtcccacttgtcttacctcttcaataataggcgataagtgatgtattgtcatttttgcaagcccaaatgtttcacatttgtgaaaggaaaattgtgaccaggagaatttgtgatgtgactttatataaaaatatatgtgtgtaaataactatgtgtgtgtatatacacacatatatattcatatatgtacacacatacacatatatgtgcataaattctgtatgtgtgcaaacatatatgtgtgtgtgttcatacatatatatatccacccatctttccactcacccatccatatatctattaatttagcttgctatcttcctgtatacagtattactacaatgataaaatgggatcagagtttcaaaaaatttagaattcaaaagatcctagcaggtaacttggagacaaagaattttattcccagagctctaacactccaagagagaatcggtactaagaacccagtgggaaaataatccacatgtactgattcccagttcaatttcattccccagcactacactgtctttgcacagatatttgatataaagatagatatatactgaaccttagaaaatagtgtcagtagtaaaactactttatgtgctgaataccctgctgtcaacaagattttcatttgagttttgaaatttactgatgattactgtcagtcccacctccacctcctgtctctcctcctaggcatttttcaatatgaggaggacttcctgtcagatatcaatcagttcttccaaccagaattatctattaaagtattgtctttaaatcagagaaaattgatgtttatgtcaaagacagctttgctgactcacatacaaaaattacaaatagcatttgactgctctatcctcagctatatgataactagataagtggaatattctttctaccataattttgttttatagcaagacacaggtactaattccatgcagtacatgcctaatgtaatgataaacagatgatccctagcatagctaaacactttaaagaaatttctttctcaagtaagacatttaccttttttttttttttttttacaatagaagagttttgatctgcccctgtcatccccaactgaattagttacatgatttcctttttttttctttttttttttttttgagatggagtctcgcactgttgcccaagctggagtgcaatggcgcaatcttggctcactgcaacctccgcctcccgggttcaggcgattctcctgcctcagcctcccaagtagctgggattacaggcgcacagcaccacacccagctaattttttctacttttagtagagacggggtttcattcactatgttggccagactgctcttgaactcctgatcttgtgatctgcctgtctcggcctcccaaagggctgggattacagctgtgagccaccaagccctgtcgatttccattctttatgtttccagcttatctatttcccaaagaccaggtcatatctgattaccttacagtctatgaatatatttttgtgtgtgtgaagagtgggtctacagtaggaataaagtttgcctatagtcattttctatgttgctctaaaattattctaaactcctctaataaaaacttacaaagaaaccagacaaatgtgcatatggatatgactatgaactaggaaacatccagatgccttggaaaaccctaagagaagaaggaataactcacgatatgtggaaatgcaagtgagataggtgagctggaaaatatatcatcagtataagccttagatttattttgcataattgaataaaattctttaaaaataaaaaggtgagtgttttaattaaacttgacaagtgacaattaagttaaacataatcttttgtttacaatcactttgattggagacagaaggaaattagaaattaaagtttgttggctgggcacggtggctcacgtctgtaatcccagcactttgggaggccaaggtgggcggatcatgaggtcaagagatcgagaccatcctggccaatgtggtgaaaccccgtctctactaagaatacaaaaaattagccgggtgcagtggcatgcacctgtaatcccagttactcaggaggctgaggcaggagaatcatttgaacctgggaggcagaggttgcagtgagctgagatcgtgccactgcactccagcctggtgacagagtgagactctgtctcaaaaaaagtaaaaaataaaaataaataaaaaataaaaataaaaaaagtttgttagaagccatactgtgattagcaacatctatatgaagatacaccctccaaaaatgtctcctgtttattgtttctttgttagaagagctcttgattttaaaaacgacgctacagagaatataattatttttcaatcatatgttccccagtcaacaattttgcagaaataaaacatacttgtatctctaaactcaagataattttcataacacaatggttggggaaaatcttgattacattccaacaacatttggtaagacttccgaatcttgtgtaaatattttgaaaagcctgcaatgtgtcttagaaaggaatgtgaaactctgatattactggggttgagagaagtcatgttactgcaaacaaaggatttttgttaacattaaatttgttaatagattgttaggtgattgggaaatgttgttttaaaatatatacacagaaacataataggtttttaaaacatttgttttattccatttcaggatatttgttggggttgttggcaaaacattaactaacattttacaagataaaatagtaagaaatagcttcttggttaatatgttaaatatactttatatttcagaactattttaggttcacagcaaaattgatagacagtatagagttttcccatatgtcccctgctcccacacatgcatagcctcccctatttggtacatttgatacaattgatgaactcacattgacacattagtataaacaatatgactccatagtccagatgccatagtttacattatggtttacttttggtgttgtcaacaatatgggtttggacaaatgtataataacatgaagccactgtgaaagaaaaatttgagacaaatttagctgcatttaactgagcaaagaataattccagaattggacagccctcagaaccagtaaagattcagaaagctccactgagcaatgtgggcaggcagtatgaaagagaaggggagagaaggggagggaagggaaggggaggggaggggagggaagggaaggggagggaaggggaggagaggagagggtgaaagagatgtacagagaatttgattgattttagctgggtatttgccttacatgtacacagcctgatcaattgaccacctgtgattggctgaagctcagctgctgtcattggctgagactcagctatttgttacaagaatatattcttaagataggttgaagtatgtttacatactaagttagggtgtagtttgctatgtagggattcaaagtatgaagtcagctttaggccaaacttagtttaacggcatcattatagtatcatacacagtagtttcaccgccctaagcacatctgtgttcctcaatttcctggttaatattttgatacaaattgtcttatgatcatgaatggattcctaatgttaaacaggagatacttttacaaataatattttgtttactttgttttacaaaaatatcatcttatctttaccacaacacattaatttagttattattaccatttgcaaataagggaactgaggctaagagaggttaaataacttgcgcatggtcacatagctcatgagtggaggagatcagaatccaattcaatagctccgaaagttttaaatatgtaggagtactaagttcaaccaatcaaatatttattaagtttctactgtatgtaacatttgctattaggcattatggagggcaaagaaaaatacctggggtcaggtgcagtggctcacatctgtaatcccagtgctttgggaggttaacggcggaggatctcttgaggccaggagtttgagaccagcctaggctacatatggagagtctaaatctacaaaaataattaaaaaattagccaaccttggtggcacatgcctgtagtccttgctactcaggaggctgaggtggaagcatcatttgagaccaggagtttgaggctgcagtgagctatgttcatgttaatgcactccagcctgggtaatggagtgtttttgcattactggagtttcccatcaagtagaaggaaagtgcatacatttctttattataaagatctaaaaggagatttaaaagttaggaagatgaaaaatggcaagtacttatgcaaacaggagttttataggccatcttgatgaaaactatatttaatataggacttgaagaatatagatcttgcataggaatttgatatgagctagggcataaagggtaggacattgcaaccacagcctacaatgggaacaaaggcctggaagcaatggtgtcatatcagggagatgtaggcatgcatatcctcagaagcaccttccttttttctttccttcttttcttcctctcttcccccatttatttatctacccagaacgtgtttatttaatatccactatgtttcaggaactgaatagtaaaacacagattgatccattcttagtatacacacattttttttttattggaggaaggggtagagatctgtgatagagcatagcaagcaaaattttattttagatgagctggtcaggaaggtctctccatggaaatgacgtttaagctgagacgtgaacgatgaaaatgcagtaatattgggagaatcagaatgacattaggaaggacttgcacattttcttttattctatatacaataagctttcaaagatgtttgaagagtctgatggttaatattgagtgtcaacttgattggattgaaggatgcaaagtattgttcctgagtgtgtttgtgagagtgttgccaacagagattcacatttgggtcagtggattggaagaggcacacccaccgtcagcctgggtgggcaccatctaatcagctacaagtgtggctaggataaaatcaggcagaagaatgtggaaggactagattggctgtctcccaaccttcttctttctcccgtgctgaatgcttcctgccgtcgaacatcggactacaagttcttcagcttttggactcttagacttacataagtgacttcccaaggggctctcgggcttttggccacagactgaaggctgctctgtcagcttccctacttttgaggttttaggacttcttgcttctcagcttgcagacagcatattgtgggacttcaccttatgatcgtgtgactcaatactccttaataaactccctttcatatatatatatatcccattagtcctgtccttctagagaactctgactaatacaaagacagagattatagtctaatggaggaagtaggaatttgtgtttcccctgaaaaataaaaagtctccaggaaatgacaccataatggagcccaacttttccacccattgcaaatgccactttttaaaaaaatgactatctccctttggtcaatctgtagtgcactaaatttgttgaaggctgtgggcactaagaactaagcagaagaagcaacttgattatagtagagtagtttgaatttaagcaaaattctgtccttgaaatatacagatgtttttgtaatagaatttgaaaattttgtgggtttctttgaataatgaacccagaccctgcacccagttactctccttaagagctattatgacacctaattagtaccataaaatggagagtacacttaagatagatgtgaagtaaacaattgcccacaccagaccctgttatatctgctggtggaaatgcagctcttccccctgggtgaaagaggcaaccgtgctctttgtgactggaggttgttgaacaaaatcagcaacctcactacaacatgatcatgtaaagtgctgggcctgaagaataactaataataatggttaaccatttattctcccttgagctcagtatcccatcctctcctcctctttctactaggcttaggaaaagcagaagataggtttaaaacttgttttcagggccaaaatgttcaaatgtacaggttgtgtgctgagtatatctaaggtgtgtcattcactttattgtttatatgaatagtgcctcctgaggttctataatgcacaatccatgaatctgtatatgacttcctgcttgacttgattttattcatatattatgggcctttatgttgatcattcatttttacattctatgcattttgagtaatacaaacctagtattggtttcatcactgaagccacaaaactgggttttagctatctcaatatatctatatttacatataggcaacaagcaaaattatatacatatggcatataattttatttatttctcataacaatactaagaagagggttttttattataaacaatgagacatttgcagagatgtgaagtaacttcctagtgaacaacagagctgaaccatggctcagagaaccatataagatagctgaaaagtgaagaaaggctagaagcaacacattcacagagtcagcagtaatagaaaactcatcaagaaaataaatctggatagagccaggaaaaaaaaagaaatcagaagtgggatgaaattttgcaatataatcacatttttatttctataattagatgtaagcataaggaagagataaagataattcccgtgtcaagcctatgtaagtggaaggcttaagatatgttaacctgagtctcatgttttgattgaaaacaaccacctgtatctattccataggccttgtttaaatctaaacatattctttatcactgtaactctaggaaaatgactttattttccttggcctcaatgccttcatctgcaacatgagagtagtaatatctacctcgcatgggacttgaaatcaaataagtaagacacaagcagagtctccagcatttatagtcactcaatgaataactattaatgttatcattaatctctggtatgggaaaactattatataataaaatgatctgtaattcattattttgaaaatcaaatagaatgcaaataatttcaaatactacacccttccttttttaattctcaccccgcaagagttgtgcttcagacaacaaaaagagagtaatttctacttcaactgaaaagtaatcttaataagttttttcatcatgtgccaccatatgctaaatatgaccataaatcttcactacccctccaattgaaagatagagtattatcttttacttttgagtttgggctaacctagtgacttgcttgctcaaacgaatgcaacagaaaaggtgttcttgaaattctaaggccaggccataggaaatatgacagttaccacccaagcctcttgtaatgctcactctgggggaagccagtcactaacaattccaactgctttgaaatttccaaattatgaggaatcccaacctgcatggaaaattttcataaagaacggaagaaagtgtaaggagagacagagaacagcagtccacagttttttcaactataccaactcagagagaagatacgtgagtgaagaggtcaccttaaatattccggccccaatagatgtgatgtaaagagaatcttagacagaaccaaggatcccagacttataacccaagttaagtcatctatttttacctctagccattgaagccagcacagctgaagccccagtcattgtggcacagtgatatgcctttcccaggatgcttgccttaatttttgacccaaaagtcctgattataacaatttttttttctgtctaccatggaattttggagtggtttgtcacactgcaacagatatctggggcatatgccttgggagttctaatagttctaaagccacagaataacttctacccataggcagggaaaatgaaatatcttgcttattttcagtcttcttttgagtcatagaatcttttcaggagcttcttcagactgagtaaatagaagagaattcttgattccaaaactccatcattacaagctacaatggaaaagccaaattctgcttgcacataccccattgttgtgcaagtcataaacaattgattgtttcctgaagtcataaacaatatctgggccaaatttgtaagtacttgaaactgattaaaagtaggcaatattccatcttcaaccttcttccctccaactcaacttttgatgatgctctagttaaactccaggcttcctgatgcacctccaatctctaaaataagtaaagaagggggatcttcagaagacttcagatatccagcatacaagagatcaaagaaagaccagagcagcaattgtactgtccagaggaaaaactgctgaatgtacactgccatatccagaaggaaagccactagatgagagaactgagcatacagcacagctatattgttgactagtattggaaaaattaaggtcaataaataggtttctggaatgatgagcccgacgccatattacttgcaccagagttgggacttaaccagcgtcaaaacagtccaagacccagaatcattacacttttagcccatgtcagggagcaccaaacttttggggctattaattgatgtgttatgtttctgtgcataaattttactgtctagtaagactaactcctggtcttcgggtatcttgcctgcaatttttattgtaagctctctgctccctcttaggccaaaatgtatggcctcagcatcagatgttatttattgttggtgcttctgtccaccaaggaaagatagaaatataaaagcaatcctggctctctgactttccctcataaccccctcctttctccttttccctctctccaataaattagccaatttttttctctgtccaatatatcatcatggttaatcaattgtgcttcttggtatctcttaatttttttcattttaatataattccattgtcctgactcagatccttgtcttgctaggcttcctgcagctgccctccatatatttctgcttccccatgacaacaatttcttctcatattcattctgaacacagctaccaatattattattcctaatttgcaaatttgatcatcaattatctgcctaaaatctttattatttttccactgacctgagagaaagtccaacttctgaatatgtcataaaggtcctcattttcctgtcttggtctgacaatttagctaatctcttcacactttatacaccagtaattaaaacgtgctatccttattgttttacaactgttagcagttgctgttctcgctgtcaagaatgtttatttcctttcactcacttagaaaagctcctattcattctttaaaacccaaacatacacatgacctcatcaatgaaacctattttcacttcctccaccaaattaaatcactctcccttcaaaattctaaaactacacacatatggtacttctgtgtagctcaactgtttgttacacattaatgacaaatcagttctttaaaaggcatccatacttgtatccccaacatcaaataacatgtctgacatttaataagcactgaatacttgaattaactattgaattgaattgactactctcgagaacactaatgattgttagggtttcctgaatcaggagtacaaattcatcttggatttttttaatactgctagtcttgattgagggaagatgatcattaagtttaaaacagacttccctctgtgaagaaaatatctgcagtcagaaataataaataaactcacaagtctatagaggaaactgggtggtctggtgcttttgttctcacccaaagacctgctgagatttgattcggagggggaagattggttttcttgcttaagttaaacgaggcatcaaataaatgtcaaaaccttgatatagtcttagattcttcacgtcacaccaataaagttactatccttccatctcccttagaacaaatgcaagaaagcctgctgtgggcccccaacaaaacagtgactgtaaatttactcggttccttaaacttccaaactgtgtattgaaagtgaataaatgccctgtaattacacacatgtaagcagattattttcatcaataatggttttatattttaagagaagtatttttccatccagaatttagtcacaatgtcttatatctgaaatgtttaaatataaacatttaataattaagactacgattagaaggccttatagtattagcaaacacttattataaagagatacatttatatcaacccaaactaaacttccagttaaagagatacattaatatcaacccacactaaacttctaggacttcagagggaaaaaaaataaaacatgacaaaatgcaaaagatacacaaagtacttactttagctttgtaccagtgaaggtaacagtctattgtacagattgaaataaggaaagcaatgaaagaataaaacttttcaactgatacaacaagctgtctgttaatgctggttgaactcatgggcaaatactactactgcgcatttccacttaatgagacaggtttattttaacactgtcaccactggttttgttcactaagaccatgaaaattttagcatgcatatgtacacttgagttgagagtcaggagacttcttaaagtgtgcactcctggcccctgtttcaaaagattattaagtagttggaataggttggaaccaggaatctctattttatgaactgagttgaagattctgatgtggaaattcttcatacaaaactttcagaaactctagtttaagtaggcagagtttcagggcttattttgtgcagaataaacctggtatattcttattgtcctatacccttttcttttctctctcaaaactttctggcttagtgataacttgtatgacgtatttgtcccattagtcttaggacacaaaggcatctttccataagtttaaagattctatagactttaaacctgctcagaaaccagagaaacagttgaccctttaaagggtacaggggcaaaacaacttggcccaattagagaggtatgcaatcttccagaagcacctgaagaattgccactttctccttggaatcaattgtgccaaacagacttcattaaaccagttaaaatcacttacattggtttcattaggatttacccacactcctggaatttgacttgagctgagctagcttttcctatgtgaaaatttgatgagccatttgaatcgcagtattcaatttctgttttctcacctctttgaacacatctttagccttttctcccttatgagaagattattatgcacaagaaccagggcataatttatatgatttcactgtaacagcaaatctctattgtgattccaagaaattcacgagtgctttggaattagtgcaatgagtatgtgatctcatatttatttactcctagtgctgtcatcatactgataaattctgtctacacaagaaaacatttatattgttcaaatgtctgcagataattttttttccttacaactttaatattggattgaaggggtacatgtgtcatttgttacatgggtaaattgcttgacatgggggtttggtgtacagataattttgtcacccaggtaatacccaatagttagtttttcaatcctcaccttcctcccactttgcaatctcaagtagaccccagtgtctattgttcccttctttgtgtcaatgtgtactcaatgtttaactcccacttacaagtgagaacatgcaatatttggatttctgttcctatgttagtttgcttaggatggagctccagctccatccatgtttctgcaaaggacatgatttcattcttctttattgttgtgtagtattccatcatatatatgtaccatgtctttatgcagtccactgttgatgcgcatcttggttgattccatgtctttgctattgtgaatagcactgtgatgaacatacgcatgcatgtgtcttcgtggtagcatgatttattttcttttgggtatatacccagtaatgaggttgctggttcaagtagtaattctattttaagttctttcagaaatctccaaactactttccacagtggctgaattaatttacattcccaccagcagtgtacaagcaatcctttttcttcataaccttgctagcatctgttatttttttactttttaatagccattctgactggtgtgagttgatatctcattgtggttttgatttgcatttccctaatgattagagctattgagcattttttcatatacttggtggctgcatgtacatcttcttttgagatgtgtccgttcatgtactttgcccatttctaatggggttgtttgttttgcttcatttgtttaagttctcttgttatacctttgtcacgttcatagtttccaaatattttctcccatatatcaaatgaacaaacattctgccatagaaggtttggctctgtttcagaatggttggctgatatcagcatccatacttatttttcattaccctttactctctaaagaagacttaatttcatatgattacttagcattcctgatttgatctacttcagtctacacctacctcacttagttaacatatttgtatagtatttcttgccagttaagttaaaatatctgccaaatcttttccaaactactattttctgcattcaacacatatatcctaaccgagaacttgcctgacctggtgctaggtgctagggtcacagttaagaagtgcagtgctgatcaagaaatgggttgaattttaaagaaggcaaaagaataaatacataatgaccctctgtgtggcggatgctctgagagagattcagacacatggtgtaatggaatgatgtaggaagagcaatagggattgctaataaaaggtcaaatctccttaaatttacatgatatctgaattatatcttataggactagtagcaactcaccaatggaatgagggcatgaattttattctaggccaagtaaagaatgcgtgccacaatagagatgcataaaagagcttctaaaaatcagggatcagtaagcaaaacattttggctcagtcatcacgatctggggtagaagacgtagaggtctgagtactttagcaaaagatgaagagatggggccacagaggtaataagtggccttgtctatcatgcctaagagctgaactagatcttctacacaatgcacactccatgtgattttagtaaaaagaacaaaatgatttgatttttagaattatcatactagcagaggtgtgaataatagattgtagtgaagttaattgtcccacttatggagtggtggcattaattaggtgaaacatgtataaactcctgaaatacagccgtggtagttgcatgtatattgtatggatacagattcaagaaataataaagaagcagggtcgagcaaatttggtgactgcttggaaaatttaaagacagccccaaatatataatttaggtgagtgtatggatcgtgggaggctccactgtcataaggaatgcagtataactagtttgtcacagtaaagggagagatgataattcagatgggatgcctgagagctgagattccacagtcaatttttagtggcaatgtcaatctacctataataaaatatcaagtatgcttctaaaattagaattaagatgctacctgaagtcaaagaagtacaaagtatttcctgtaaaagtatgttccatggtaatagatgaggaagatggatagaatcccttggcacaggagtaattacaaaggagaaagagggaaagaagagagcaaagataaccaagacacgaaaaaaaaggggtagaaagacaataaacattttttaatagccctattttttctcccctactcacccaagagagcctctggggaagagctaagcagccatttgcctcagctgagtacagtttgatgttatatcaataatagtagctaatgcagcaattaccaggtactaggcactactccaagaaccaaacatatcttaacatagtcagtcttttcaataaatgtataaagaaagtatattacattcatatacgagaatatcacacaactagcaaatgtcaggcatgagattcaaattttggccctctgtctccagggtctgtgtgtttgataattaaaggatactacttcttcagtttgaacatcacttatctaatgtaaacacattgtgcctaagggggaaacaaggccatgagacgtttaatgacttttccagtgtcacagtgcattgtagtagcagagttagatttaaaacccatttcaagaagtcctactagagtattgtggcctatgagctaccatgcaattgaaatgtgaagactagcagtctttactttttttaatccttgttatttattattttattaaataaaagtcattagttttcacattttcaacttcttcctgagatttgttttttcttttaagtcctttgagtgtctctcccattctacccagttacccttccaaagcaatgttgttttccaaattatccagcaaaaatatatgtttcaatttatttaacagtggacattaatgacagatgctttactgaaggatgaaatgcagaaataaatgaaagagtagtgttgaaattgaacaatgcatatgtaatgaatgaaggaacaaagtaacagttcaacataatgccgttagtaagtgccagaagatgattctccatctaatggaacaaaaactattcttccacttagggaaaatgaagtatattttgttccctagagtattctcataaatattagctattggacactttaaagataatataatgatagagtgatgcttcacatgtacacatatagtcatttataactcttgctggccttataatatgtgtgtgcatatgcgtatgtatattttcccacaatagttatgatgatgcaaagatacacacacgaacacaactttgcatagtattcaatttgtagctaataggagtaaaagaaatacaaagatttctaatatatatatataatcaatatctgattgtatatttaaaaagaacaaacactgttttgaaataatgattattaaaaatgggaaacggcacatatgctcatatattatttcatagctgtacagaaactctggaatcctagaacttgaaattttgaaatgtacagttttcccacagtactcatggggaatttgttcaacgaacccccacagataccaaaactcatggatactcaagtcccttacatgaaatggcattgtatttgcatataacttacacacgtcctcctatatgctttaaacaatctctagattacttataatacctaatacaagtgctgcataagtagttcttatgctgtataattttaaaatttgtgttatttttattgttgtagttatttttattgtgtttctggaatatttttcatctgtgattggttggattcatggatactgagcctgaggatatgaatggtcaactgtgtttttcttctcctatgcaattgttttgtggtatgcaatgcttttcatgagatttaatgtagtagagcagagaatgagtggcaatcctaaagggaagtcttgcagagcgctttaaatcctacatatatggaaaacaaacagctgaagactaggagatgaatcaacttctttaaaagacaaaaaaaaaaaaaaaaaagtacagatgtgtgttagacaaacagcttgaccaaatttggttcttaagaaacacacacatggttgatattaaatcggccgccagtgcactgacactctgaaagtaggccatgatttctaaataatctcactctatttttatatcaattaataaatccttccaagactaaatgaattggatacaaaatagctgtgtatagagaacggttgaagaagctttttttcaccttacattttgacagaaaagggcaatggtacttctgatagataagctgcctgagggaatgcaaagggcttagatacttgaacaagcccaaactgctgtcaaagtgccagccatgggtatattccatgttactggacagaaaacagtcctaaaagaaacatagatggtgtcttctgtttcttgtaatgataaagatacagttcactttaccaaatataaaaatagtattgaaggagtggcctccatatacgagaaaaggagagagaatcgccaaccacattaattcctgttaattcttctcaaaagcatgcatatttcaaagcatcgtgttgtacaccataaacgcatacaattttacctgtcaatttaaaaataaagttaaatagaaaaaatagaaatgcattttggtgcaaagagaactatgaaaagattacaaactttctgacatgaatgatctgcaagagaatctctttcgtaaagttattcaattagttgcactggaaattttaaattaaaagatctaatgttaatgaaattgttaaaagtttttaggaacctgctgaattatacatctagcaagaggtggacaaggaagtcaagtatttaagaagagtcatcctcaaactttagtatacatgagaatcacccagcgagaagtaaaaatccagtttatcagtacatagcccccagaccaactaaatcaaaacctctttcagtgagacccaggcgttactatttttaaaacttccctggtaattccagtgtgcagttgagtttaagaactgctgttttactacagttgaaaggtttcttttagtgatattctggtacaggttaaagaaagagattaaatgttacaatcaggtcaaagcgagttaggtgtcttaaagcatttccctaaggcttatgtgttccctttttttttgtcttttaagtaggatgatgatacataccccattaggtaactgtgaaacttaaattaaggttaatgtacacagtaattgaaacctgacagttattaagaagtgtaattatttttctcctcttcatacatttatactgtcactcatgaaagtgctttcattacatttgtccttaatttatttcatttcctcttcttttcttcttgttcctccttcacctcacttaagccctcctccacatgcattttaccttttctcccctttctttctgattctatcttctgtatttgcccttctttctttgcttaagttcagtgtcactgatgggactttgaaatgaagactttgagaacttgttttcaggtattctgtgattgtttcaggtattttaatcccaaattaagattggttttacttcagcagatagcatttttcttcctccagctttcgtaacagccaatccccaaataacatacacaaattatttcccgtatatgctttggccactggatggtgctcagagtacacattcggtgttccatgattaagttacttcatcctactgagttaaaatgtatccagaaaccatacaacatttaacaacttttgagaaggcactggtaagatggggagacttaatttgaggaaagtatacctgagtataatattagctactcgaaggtcagtaccacccagaaggttaaagatgtacgagtcctatatcccacatatacaaatggaaatgacttgggctgggcatagtgggtcacgcctgtattaccaggactttgggaggttgagacaggagtatttcttgaggccaggagtttgagaccagcttgggcaacatggcgaaaccccatctctacaaaaaatacaaaaattagccaggtttggtagctcatgcctgtagtcccacctacttgggaggctgaggtgggaggatcacttgagtccaggtagtggaggctgcagtgagccatgatcacaccactgcactccagcctgaatgatggcctgataccttatctcaaaaaaaaaaaaaaaaaaagaagaaaataattggcttggtggtaataggaacatagctaagaattgtgtctttgcagtgttatttctgtgataacacatgtgaattttggaataaaatggctacattcaaaacccttcacctaaatttactactgctatcagttaggatatttaatagggctacatagcaaccatactgctgctcaaaaaagagtggcatacattttcagttcagatttaaatatataatttttgttttctataaatagttttacaagaccttatgcatgggttcagaaaagaaaaactgatgattaacaaaggaactgaacagaacactatcaatcagagcaagcctggattgctgaagtgaactgatgaagtcactggagaaatacagcctaggaagtatttctaggttttatgtctgaattgtaagcaattaaaaaaaataatgggggccgggcgtggtggctcacacctgtaatcccagcactttgggaggccgaggcaggcagatcacgaggtcaggagtttgagaccagcctggccaacatagtgaaaccccgtgtctactaaaaaatacagaaaattagccgcgcatggtggcaggcacctgtaatcccagctactcgggaggctgaggcaggagattgcttgaactgggaggcagaggatgcagtaagccgagattgtgccattgcactccagccagggtgacggtgaaagactcggtctcaaaaaaataaaataaataaaaataaaaataaaaaataatgaaaaagactaaatattttcttttattaacttccttaaaaaaaagttgccatcccatcatagacaatgctgatgtaagatcactgcataatacctggaagcaaatcagaagcaacaggacatgtgttggattacaaaagaaataacaactatgtctaactaaaacttgcctaaggcatctttttaacttctaatgtgagaacatagattttaatatctgatgccaccgtataaagtccctcacttctttaattcacatatataataaataataatgttttctcaaaaaatacaaaagataaatgaaacaaagagctgataatttgaaaagataaaattgatagactgttagattaacaaagtaatgaagacagaagatccaaataagctcaattagaaacaaaactggacatattacaactgataccacagaaatagaaaagatgattcaagtctactctaaacaccttcatgagcacaaaatagaaaatctagagatgcatacattcctcaaaacatacaaccctcctagattaaatgaggaagaaatagaaacactgaacagaccaataacaagcagcaagattgaatcagtaattttaaaaatgccaacaacagcaacaaaaaggccaggaccagatggattcacaggtgagttctatcagacattcaaagaacagttggtaccgatcctactgaaactattcgaaaagatagagaaagagagaatcttccccaaatcattctatgaggctaatattaccctaatagcaaaaccaggaaaggacataacaacaacaacaaaaactacaggccaatattactgataaatatagatgcaaaaaccctaaaaaaatactagctaactgaatccaacagcatataaaaaagataatacatcatgatcaagtgggtttcataccagagatgcatggatggtctaaccacgtacaagtcagtaaatgtgatctatcacataaacagaatttttaaaaaatcatatgatcatttcaatagatgcagaaaaagcatttgataaaatccaggatccccttatgataagaaccctcaacaaaattggcatagaaggggcacacctcaaagtaataaaatccacctatgacaagcccatatccaacattatactgaatggggaaaacttgaaagtatttaccctgagaagtggaacaagacaaggatgcccaattttaccactacaattcaacatagtactggaagtcctagccagtgtgaccagacaagagaaagaaataaaatgcatctaaatttaaaaagaggaagtcaaactgtccctgttcactgatgatatgatcatatagctggacaaccctaaagaatcatccaaaaagctcctagacatgataaattaattcagtaaagtttcaggatacaaaatgaatgtacacacatcagtagcactgctatacgccaccaactaagctgagaatcaaatcaagaactcaatcccttttacaacagctgtaaaaaataaaataaaatacttagtaagaaacttaaccaaggaggtgaaagatctctacaaggaaaactacaaaacactactgaaagaaatcatagatgacacaagcaaatgaaaacacatcccatgcttacagatgggtagaatcaatattgttaaactgaccatactgcccaaagcaatctatacattcaatgcaattcctatcaaaatgccatcatcattcttcacgtaactagaaaaaaaccttaacattcatatagaaccaaaaagacctttcatagccaaagcaatattaagcaaaaagaaaaatgaggaagcatcacattatccaacttcaaattatactacaaagctctagttaccaaaacagcatagtactgatataaaaataggcacatagaccaatggaacatagtagagaactcagaaataaagccaaatatttatatccaacttatctttgacaaagcatgcaaaaacataaggtgagtaaaggacaccctatccaataaatggtggtgggaaaactggcaagccaaatatagaagaatgaaactacatccttatctctaaccttatacaaaaatcaactcaagatggatcaaagactcaaatccaagtcctgaaacgataaaaattatagaagataacattggaaaaactcttctagacattggcttaggcaaggaattcatggctaagaacctgaaagcaaatgtaacaaaaacaaaaatgaataaatgggatctaattaaactaaaaagcttctgcagagcaaaagaaatcatcagcagagtaaacagacaacctatagagtgggagaaaatattcacaaactatgcatcctaaaaaggactaatagccagtatctacaaggaactcaaataaatcagcaagaaaaaaacaaataatcccatcaaaaattgggcaaagtacatgaatagacaattctcaaaagaagatataaacagccaacaaacatatgaaaaaatgctcaacatgactatcaggtaaatgcaaattaaaaccacaaagagataccaccttactcttgcaagaatggccataattaaatcgtcaaaaaataatatattttggactggatgtggggagaagggaacacttttacactgctggtgggactgtaaactagtaaaaccactatgaaaaacagtatggagattccttaatgaactaaaagcagaactactatttgattcagcagtcccgctactgggtatctacccaaaggaaaataagtcattatatgaaaaaatacactaatatacacatgtttatagcaacacaatttgcagttgcaaaattaccaaaccagtctacatgctcatcaaccaacaagtggataaagaaaatgtagtatatatgcattattatggaatacttcttagccataaaaaggcacaaaataatggcttttgcagcaacttggatggagctggaggccattattctaagtgaagtaggaatcgacaactgaatattgtatgttctcacttataagtgagagctaagctatgagcatgcaaaggcagaagaatgatacaatggactttggggactcagggggaagtgtggaagggaggtgaggaatgaaagactacacattgggtagtagtaaaatgctcaggtgacaggtgcaccaaaatctcagaaatcaccactaaagaacttatccatgaaaccaaaaaactacctgtacccccaaaactattgaaataaaaataaattttaaaaaaagataaaaaataaggaaatttccatagtgagacaaggaattcctgaaaaagccctccttgcacttgtccaggggaaggaacaggagaggtcagaatgttcgtgatttggctgcagtttctaaggccttttcattttagttcaaagagttaacatgccaaagtaccaacattgtgaggcatgaatttcagggtcctaataatagtcagaaaaatgcaattctcaccttcaacacatttactaatatattacctataggcacagagggtcccaatacaaaaggggacccctttatattattttttgacgatttaattatggccattcttgcaagagtaaggtggtatctctttgtggttttaacttgcatttacctgataattagtcatgtcgagcattttttcatatgtttgttggctgttcatatcttcttttgagaattgtctattcatgtactttgcccaatttttgatgggattatttgttttttcttgctgatttatttgagtcccttgttttgtacaattttttgtacaaaaattgtacaaaaggggttcctaaaagtgttatttgcaaatatactgagttcttactctgtgtcacttggaattttcaaatgtctagtagtaaaaacttatgttctactaatattaaattagtattagaactctagatagttccttattgcaattttaattttcaaatgtaggttcagtaatttttgagtaaacaatacttctaggcattgttacaattcattgattttcaaatttctctctatgttgtccttaagttttatagtggtacttcagaaacaatgatgagaagtcaggacaaggcccatcatttagggtttccaggactaatatcaactttatatttgcaaattttacaccttagaattctttgaaagttattatcaagaaaaaaagttttgaaaacaacagatatagacagatactgtagtgggctgaagagtgtcgccccaaaatccacgtcaacacagaactttggaatgtgatctcatttggaaatagggtctttgcagacgtaattagttaaagtcttgaggttaaaatcatccaggatttaggatgagcactaaatctgataactggtgccttataagagagagagtaaaaaaggagatttgggcatagaaaggcatgcaaacacagaggagacagagacacaggaacaaggtcttgtgaaaatggagactgggattcaagttatactatcactagctaagggatgccaagaatttccagcacctactagaagctaggataggtgcatgggacagtttctctgagcttctagacaaaaccaaacttgccaacaccttgattttaggcatctggtcttctaaattgtaagtgaatatattgttgttcaaagccacaaagtttctagtaatttcttatggtagcactgggaaattaatacagataccaagattaattttacttcaaaattaccttatcaactcagtagcaaaattagtgagtggttcccacatattttacaaaatcctgaaacctgcaataggcagaataagtaaatatcacccttaacgaagagtattctagaatgatgattatactataaattcatttggccttcttcccagtatttccttttctgtcactactgattctttgggatagccaagttcaaggtgactcatgactggtattacttaatgacagtccataaatggtcctattcataccttccagagacctttcaggactgatatgagagccaaaagtcatgggaaggtctggcagtgattgtggtctgcacatcaaagcacttcctgaaaaatgtaataggccaagatatttggggaaaagcagacaaatgaggaagaattcctagtcagagctaatttgagagtggggataaaaactacctgttaaatgatttactgctcttaagccatagatactgttgactttattctgctgcagtttctaaggctgttttctgctagttcaaagagtcaggaaagaagacaaaaaagatatgtcttgagattatgtgccagtttttgccagtatacatgctaatgacctatttcataccttaatcatcaaaaatattattagtggtatccctgttctatctttattttttctactaccaataagttcctcatctaatataaagatttctcttaaatatttgtactcaaaaccttttattggattgcatttgtatacacatgaagtccttacatcttagccacaattcaagcttcctcttggtgtaaattaatctatcttttcatctttaccttgcactattccattaaataatccatgcacacttaagaaacaaagtgtgtattgccaaacttactttgcatttacttttattattctttatcttactcattccgtaccttcacttgctataatctcttcattttctatgtatcaacatcatatctcttttaaagtttacacacttccctcatcatctaagataaattaatctcttctttaataaaccccaataattttagcatattattgatataatactagacatctcattgaattttaggtatttttgaaatcataaaatcacagaacattctttatagaacaaacttagtagtatgtctccaagtatccctaacttgcttgatgaaaataatcatctgggagggtgcttaatgggagaaaatgtcccatgaacctatcttagctcctagtagttgcaggaaatccttggcatccattcgcttgtgatagcataactcgaatcccagcctccatctacacaagacctgaatatagattcctggatgctgcctcaattctacttcatcagaggaagagtctggacatacgtacatttagcaatgtcccagataagtttataaccactcgaatttgagaaacactagtcccgtcaattccccttattacataagtgaggtaactgtaatccctgcctgaagataaccaccatgtccagagaccatatgagtaattagtgacagaatgaaaatcgaggctaaggtaatgtgctctttccatagcataactctctcacatatgattgtaagtcttagagaatgaaactgggtctttattgtttttttcttgtggtgttttgcataataaattacacatgccattggagaagtggatagtgaaataattttagggaagtagactgtgaactctatgtcaatagcttccaaataggttaataaaaacaggcaaatgggaagaggcacagcaaggtggcagaatagaaagcttcactgattgaccacccagcaaagacatgaagttagcagctgtctacacagaaacaacaccttcattagaaccaaaaatcaggacagccctcatagtacctgattctaacttcatatactaaaagaggcactgaagagatagaaaaacagccatgaatcatggatgcctctcctccccaacccctgagagcagctgtgcggtactaagagcgtctctgggcgctgtgggaggcagagcacaacacttgtgaggcattgaacccaatgctgtccttttagagcagaaaggaaacccggacaaaactcagctgatgctcactcatgaagggagcatttaaactcatcctagccaaagaggaattgtccatccgagcaatctgaacttgagtgcctgcaaaccttaccaccaagggctacaacagtctgtgtctccaagtaaacttgaaaggcagtctaggccataaggactgcaaatcttaggcaagtcctagggctgaattaggcccagaaagagtggcctgggggaacacacaacatactgagacaccaactggggcagccaagggagtgctgacatcatcgcctctcacctaaacccaggctacacagctcatggctccaaaagaaaccccatccttccacttggtcagtaaagttgcagcatacaaaatcaacatacaaaaatcaatagcatttctatatgacaacagtgaacaatgtgaaaaagaaatttaaaaagtaattttatttacaatagccacatgtaaaattaaatacctagaaattaaccaaagaagtgaaatatcttaataatgaaaactgtaaaacgctgatgaaacaaattgaaggggacatcaaaatatggagaaatattccatgttcgtgggttggaagaatcagtattgttaaaatgtccatactgcccaaagcaatctacagattcaatgcaatctctatcagaataccaatgatatgttttacagaaacactaaaaacaatcttaaaatttatctggaacccccaaggatccagaatagccaaagataccctgagcacaaagtacaaaactggaggcattacattacctgacttcaaattatactaaggaactacagtaaacaaaacagcatggtactggcataaaaacagaaacatagaccaatggaacagaatagagaacccagaaacaaatccacacacctaaaatcaacttatttttgacaaaggtgccaggaacatacactaggaaaaagtcttttcaataaatggtgtgttgataaaactagatatccatatgcagaagaatgaaactagacccatatttctcaccatagacaaaaatcaaatcaaaatggacgaaatatttaaacataagatttcaaactatgagactactataataaaatcttggggaaaatctccagggcattggtctgggcaaagattttttgagcaataccccaggagcacaggcaaaaaaagcaaaaatgaacaaatgggatcacattaagttaaaaggcctttgcacagcaaaggaaacaatcaactaagtgaagagacaacccacagagtggacgaaaatatttgcaaactacccatctgacaagggatcaataaccagaatatataaggagttcaaacaactctatgagaaaataattaataatccaattaaaaacaggcaaaagtttttaaaatgtgtttctccaaagaagacgtacagatggcaaacaagcatatgaaaaggtgctcaacatcactgattatcatacaaatcaaaactacaattagatatcatcacaccctaattaaaaagacatattcaaaagacaggcaataacaaatgctggagagaatatggagaaaaggaagccctcatacactgttgataggaatgtaaattagtacaaccactatagaaaatattttggaggtttcttgaaaaactaaaatttaagctatgatatgacccagcaatctcactgctgagtatattcccaaaagaaaggaaatcagtatattgaagagagctgcactcctacatttgttgtagcactgttcacaatggctaagatttggaagcaacctaagtgtccatcaacagatgaatggaaaaagaaaatgtggtacatatatgcagtggattactattcagccataaaaagaatgagatccagtcatttgcaccaacgtggatggaactggagatcattacgttaagtgaaataatacatgcacagaaagacaaactttgcatgttctcacttatttacaggatctaaaaatcaaatcaattaaattcatgggcatagagagtaggaggatggtaaccagaggctgggaagggtagtggggggataggagggttgcgaatggttaatgaattcaaaaatatagttaggtagaatgaataagagctggtatttgatagcaaaaaagggtgagtacagtcaacaattatttattgtatatttttaattaacttgaagagtataattggatactttgtaactcaaaggataaacggttgaagggatggataccccattctccatgatgtgcttatttcatattgcatgatatatgaaaacaaatcatgtaccccataaatatatacatctactatgtacccacaacaattaaaaatttaaaacttaaaaaataaataaaattacttgacatagtagtttgtataactgaaaacatcatatttaaaaagagccagagagaaatcataaatacctactctattttgaataaatattggcactgtacttgagaaaattatttcccagtgctctcctgagacttgcaaggaactataaaatattttcatttgaacttgacaacttaaaaatgtgtacagtggaattctctcatgtgcagagtatatggatcttatagggaaatacagcacaggcagatgggaaaattccagtctcatttaaatacaggaggagctatgaggtttgaaaagacaaatagaaataaaagcagtatggatatctgggcatattgttttagaaaataatgaacactctctagattctccattctgaatataagattatttcactcatgatgaaacctctaggtttttgtagcattgttcttatttttaaaaagcccacttataccttcttggtgtcacaatttgtttctgtctttgtaatgtcaatgcacttggtttgatctgacaagtttaatgtcatttgataggatgaaagccaaccattttctgagagctgagtgcttgaagggcactcatccattttgtaagaaaattctattcctttctagtacttctatagtcctttctttttttattattattatactttaagttttagggtacatgtgcacaatgtgcaggttagttacatatgtatacatgtgccgtgctggtgcgctgcacccactaactcatcatctagcattaggtatatctcccaatgctatccctccccgctcccccctcccacaacaggccccagagtgtgatgttccccttcctgtgtcctatagtcctttctttagataacagaatgaaaatcaatacattatgaagtctgaaatcctgtcagaagaaaaaaaattaactctccagattttctagcatcctaagatgtaaacagaaagctatgataaatatgttattttacctacaaataaaagcaactgcctttaaaaaagaacttaccacgcagtagtcactataattacgtaaatacatgttttcagtatttcatttagtacagtatttaatagtgttttatttaatggccacaaaaatgccatcagagaggtatttttattttagttttacagattaagaaactgactcatagaaacttgaattcatcaaagtaaaatgacaatagatgaaaagacttgattcaaattctgatctgcctgactccaaattctaggtaataaccttttgctacacaaagcatgtttctaagtgcgtcttattaacctcacatggaagcatgttagaaatacagaataaagggcctactaaaacctactgaatcagaatcttcattttaacaagttccctggttgattttaaagcaccttaaagtttgagaaacctgttactagggttgagagtgcctgtcctcttgtagaacccagtgatatatatgttattaaatttagtaattggcacagactatcctttgaacaaaagtcaggctcctctgagtcctctttctgactaatccctgcccttgggttctgtgcttggcccatttcctccaacagcaagaatcctgctgggtcagattagcaaaactctcttgcccttgacatctgatccctgacccctggtatctgaccacctttgatagcttatcaaatctcttatctcatgccctctatatcttctcactcttgccggccttcaataatactcctgtagggtgcagtggttcatgcctgtaatcccagcactttgaaagcctgaggtgggaggatctcatgaggccaagagttcaacaccagcctgggcaatatagcaagacctcatctctacaaaaaataaaaaattagctggacatggtggtgtgccgtcccagctgttcaggaggctgaggtgggatgatcacctgagcccaggagtttgagggtgtaatgagctataataggcaccactgcactctagcctgggtgacacagcaagactctgtctcaaaaaaataagataaaataaaataaaactcatgtaaagttggtttacccagaattccccttatcatagatattttctcttattagtttcccattcgctcacctccactatgctctttggttataaattcccattcccctttgtgtacctgtattgaaagttgagcccaatatctctcccctacaaataaacaaaacaaaacaaacaaacaaacaaaaaacattgctgtagtttccctgaataaagtctgccttagcgtctttaacaagtgtcatgaataaatttttcttcaacataatccaagagatataaactaactggtagctcaaacattatattagccctaaagtatgagttttaaaatgagagcagtatatttatatcacacatatttgctttaaaatttagttagaatatgaaacttttgagaacatgaaactagcatgcctccatgttcattttaataaaatattcaggaggctcttgttaacataacactctgtgagttactatctgcagaaacggataaagagaagtcattgccttctaatggaatcactgtcagattcttcaattaaagaaataaaaatgggtaaattaaaattgcctcatttttcttttttctctatcctcattcttcaccaaactctcttcctctcatgtcttacttctcttgaatctttttgttgctttcttaagaaagtagactccagggtccttcagcattgttcagtctcacattcatccttcaatggagtgattgagaaaactaagcccatggagtttgagaatgatcaaactcatgtagtaagaaaaggcttagccctttcagtataactaacgtgttattctctatccccaagggagaggttggttctaataataagttctccaagaacataaagcaatgaatacaaattttggaaagaataaaaagattctagggaggcatgccccttagaccttagaaagtttctcaatgaaaatgagcagatgaagaaagcaaaaatgatcttaaaattagcctctagactaaattatctgtcagttgattatggtcagtttcaaatgtctgtgctggctatgacttattattgtttttgaaatgcataaaatattcaatgactaagtaagatcgtttaaatgagagatacttattgaaaagattaagaacatttgtttaaagtcttttaaatacaagcttaatagttccaggtgatcaggaaaatataatttaactgtttgttataatatatataacaaacttaatatatagataagcttatacatatatatgtatataaagcatatatgtatacaaagcatatatatacacacacatatataagcttatacatatatatatacttgtatatataaacttatataaacaagcttaatagttccaagtgatcaggaaaatataatttaactgtttaataaactttatatatatatataacaaaattataactgtttgttaaaatatataacatttgaaaataatgggctaggaattgtctttcttttactaccaagtagtttttaaaaaatgagtcaactggattcttgaaagcaagaatccaactgttttcattaagttctgtcatcattcatttctttcaattatcttccctttcttgttgaccatttttccggacagcaccactttatctatttttaagatcctttgatgccaaccagcacaaaggggctactggctccaccttcattattcctgaactgttggtggatatttacaccatcatttacaatgaaagcctgagccaaacgtaagacactgtaatcatcacagtcactgtgataaaatgttggtatttaactgaaagaggaaatgcattgatttggttcagctgacctgaaatcatgaacgaaacttaagtaattactttccatgtcaggaaaagggaaaaccacaagtttagcaacttctgttgtcagcatttttactttatttgtttgtttgttttcttagagagggagtgttgctctgtcatctaggctggagtgtactagtgtgatcatagcccacggtaaccttgaattcctcggctcaagggatccttctgcctcagccttccaggtacctaggactaaaagtgcatgccaccacacccagctaatttattaaaaaaaaaaaaattgtagatacagggtttctttccctatgttgctcaggctatgtttatttatttgtaaagtgagtaacagaacaaggctttaacagaaaataattcaacaaccttttccctggaaataaaaattattttataatgcaatgtcactttctcttttatttccattgttgatattataaggtattgactggaagaaaaagccttcagtaactttcaattcacttcctggctaagcatattggaagctgaaagtaatattagatataaagcagttcaattttcatattttattgatgcagcatctgatatatagagaagtaaggtacttctcccataatcacgtcactgattgccaaatcaggcctaagaatgcaaatgtcagttgcatgtgattctaatcacactatgaactattaataaattcggactcaagtttctgctttgtatctgttatctcatgaaaagaggactggggcagcataaggaatatcaaatccaacccattttctgtctcaatggataagatctatatttctttccagtaaggttctagaaggatgaagataaatggaagtcataaactgtagtccaaaattaagatacatgagactaaaatcaaccctggccatagagtagaccctgataattaagcaattatcttattgaccaaaatgagtcactgatataaagcctaggtcttcattgtaacataaggattaacttggaaagtaaaagcctgaatagaatcaagaggattcacaaaggactggagagggaactcaagattccattattacaataccactaatcagatttgatgtaaaatttttcttcactcaataactttaaaataaagccacaaacacagttgacttagaaggtagactccgaggcaaaaacaaaacaatagcaaaaagattctgaaaggtccctcttgcaaaatgaaacacttattttaaattataaagcaggcaaacacaaaaagttacttgtggcctcttatggtgagtatgttagtgtaagatacagtgcctgactcagggttctcataatcttacggaggaaggactaacatgcatgatgtgctagtcattctctgtttgctcatacattcagcttcattttctgctggtatctacactgttgctttggaaggttgtcctattcaaaattccaggatcccttgttggtttctatttgagttcagccaaagaagaacattaatggctatcagtgaggagaagaaaggttgggggatatctctctacttctgtactccggagccacatcttaggcaattgtttaacctccaagactagctctcccatggggcgggaccacttccaaggtgctagttctcacctttttggtaacagtttttccaattcttgccattcagctctagaggtggtaaaagcttcttcctgttgctcctctctgaataacaacaattctttgttttttgcctttacctgtacacatctctttctttctttttttttttttttgaggcggagtctagctctaccgcccaggctggagtgcagtgccgcgatctcagctcactgcaaactccgtctcccgggttcaggccattctcctgcctcagcctcctgagtagctagggctacaggcgcccgccactgcgcccaactaattttttgtagttttagtggagacggggtttcactgtgttagccaggatggtctcgatctcctgacctcgtgatcttcccgcctcggcctcccaaagtgctgggattacaggcgtgagccaccgtgcccggccgtacacatctctttaatagtaccttcattaaagtttattcaatttaaatatttggaatgaattctgtttcctgtcaggaccctgactgatatgcaagaaacaaataccaaacaaaaaaaagtttattatgtgtttcaaaaaaatatatatatagttggatttttctccacgtgcatatagaggaaagagtatttcaacatattggattattattctttgtatgactgtgtgtgtgtgtgtgtgtgtgtgtgtgtgtgtgtgtgtgtgtgtgttttgtggtgggagaaggggaagggtgttctttggtgaaatacttttacgaaatactgttgccacaaatgttaacaaatatttctgctttctatctttcagtttttaatatgctaacattgtctgttagttgctaaaaataaatatgtatatgcagcacatagcaaacatatctgaacacaaatcctattgttcttgggtcatctcccaagatcagtgattcactaaccataacagggaaagcactgcgtgggtcagctgaggatagaaatccaacttccttgtagccatagaatgattggacttgtgtcttgaacttttcccatggggtctctcttagatatttttctccaggatttcaccagaagcctactcagtgagaggcatacattttttttttcacaactgaagatcctgagctcaagtacctcacagtcttgtcccaagataatgttttccaccagtgtatgctgagtgttgcagtttgaggatgtcaagacaataaggaagttttgactgggcaaggctgacaggcctcccgcaaagaactaggaggtgaaaaaactttgaggaagtcaccaggctccaggattatattttgggattttaagctatattatttattagtttctaaactcagaagttattacttttggagttctggctcacagtccttaggtaataagaaattttgagttgaaactcgaaaaaaatgaatttattgagttatatttgtaaatattactttcaaatagaattgctacttgtatatattattcagtatattttcttccaggagacatacctactttggaagccacagtacaaatgtaacattatttgatgacatggaattggaacaaagcagttatctgaaacatcttagtggctagtatatctatatctccaaggcacagatatttccacccttacgctcacattccttgttcacatgataaagatgaaggcatgtataaaatatttgtctctaacttctccttttttatgcttctgtgacaaatcattatgttttatatttatatactctttggagaatattcttttgtttctcttatcaagcaattattttaattgctgtcagttcaaggaggaaaagaacaatatctgttttgtttatgatcgtattcaattgcttgacacaggtgtggcttgtagcagatgctcaatgactgaaaaatcatggctttttcatatgttaattcatttaatcagtaaatggacaagattttggggtcatgtctacatcctaaatttgcaaaatcatgtatttctactctgagtcaatatgttagttttataatttaaatcttacaatactgttttacttccctatcttcccattgctctaattactctctagttttcccacctaaaatgtacagtacagtattcttctgatggctgaggtttccactgcttcatttcatgtaaagagattctaaagtagccacaaagtatatttaaccaattcatttcaattatttcatgtattagataaaatgagaaatatatggtctctagaagggttctgtacacttagcaataagactacaaatattttttgaagataaagagcaatattgagcaagcagaagaaaattcttagggagaagcttccataagacttcacattatttgagttgcaagtttcaagtaagttagttctatacttagccagttctcaaattacctcataaaatacaggatgctctttattactaatgggcttaacatttaaggatttgttaatatcccaaatcataaaaagtgaaaggataaagtaaaacaggggcatttttggaagtgtggaaacaggaacatttcctcacttccaaatcggggatatgtcccctagataataaacctctgaagtttataaaatgattctttacttgatccaaatcatacagtgatggtcaatttgagtaaattgttgccggagaattgaatctaacacagagatgccggcaaattatcattttgaaaagaacttttactatttaattataatattagtttcaatacatttgattttttgtcaaagttttaaaaaataaacatttcaataatcgtatgtaagtagtagtgtttagagttggaataaaacatgaacatcaactagtgcaacatcctaatttaaaagacactaaaattggagcccagtatttgatctgtatatctgtgctggagccaggatagggatttcagtccccaaaagctgacccagtagtctctcctctctgacataaattaaacctgattttcatgaataatatgtgacatgttatcctaaagctaatttatacgaaggcatagaatcctttaaatgaatagaagtccatataatttttataacattgctgacaagtatgttgttactttttatttggggaaaaatccataaattcacataatttggaatagtttatcttaagggaatgcatgtaattgagaggtaaaatccttttcattgagaaagtgataaagaaacttggacaactaaaaaaaattacgtcctttagtgggtcatgaaataattctgttaaaatttgaaggaactgaaagaaagtaaaagattacatgaagaaatggacaactaagatctctagaaagagtaaaacaaaattcaactggcttcttctaacagccaatgataatatatatattgagaagataaagataaactaaagaaggactactctgttttaaaacaggatgtaattaaaatataaagtgcccgggacagtcttttcagccaagataaagttcaaagttaaacaatgcccttcagagcaatgaacaaaaatctggacagtaaaatgtggtctcaggataaaaatgaagtaaagggtgtagctataaatttttttcttaggacctcagaagcaccttcggagcatctctcacaaaccctctttgctaggcagcagaacttctaagaatcttaaaaatgtggtctggcatcatgctcataggtggtccaagataaataaagacctgtcttggaaagaaaggaagatgtggcttttgtctaatggagtgaccacccgataagaatcataagcaaggggtgggggatggggcagggggagaggaagggagggaggaagagagagaaagaaagagagaaataaatagaatttaattaataatgaatttgtactattagaagcaccatgagcttggaccaaaaggaacaagaactgttcagaatgagaataatctttggtactctcaaccttctgcacacaggaagcgcaccaagaaagctattcagatacaaacatgggccatttattttgagaaatataggatggctcagaaggctcaactaagatcccagaggaccaactggtgtttcagcaatagcactgggccctaaccaaggatctggaaacatgcttagttgaattttagaattgatgtggactattcctccttttaaatagaattgtctattaaggctatcctatcctatctcaatagtgttaggccagaagtgatgagggcagatgacttgtattctgattgaaaggaatagagctcaaagaacagcatctgaggagtctcttctgtacctggacctgattaagatgacaaggtcctggatgttcatgttattgccataagaggataagactttggcagtcttggaaaagggtgagtgcatttttttcacttgaataggatgtaaatattttctgtccagagggatgactgtggtggattaaaaatgaccgcacatcgtttgggctcctatctttgagagattttcttttccctcccttggaacatactctggcctacagttgctttgaccaatggaatactgcaaaagtgatgctatatgctggtctagatctataatttaagaagactggtgcttctactatggtctcatataaacctgagctgctatgtaagaactctgattacccagcggctgccaggctagccagtcgagagactgtggaaaaagaccatggggaggcacagacgagccaacaccctgttggtccagactgaaccattagagccacctcagctaattcatctgctataatggagcaaaagcaagccttactgccccctctctgaattcctgagccttagaattttgaagtgaaataatgatacatttttggtttcagccattatgttttgatgtaagccgttatgcaacaaaggataactagagcacaaatatagtatatgcattaataatatgcaaaatattttgtggcttacaaaaagtggacaacgttcattgaaggtgagaaatatttaatgaaatattattttctctttctcccaatcattgtgaaactcatttattggaatgcaatgaacacaattcataagaactgatgtcaacactttgatgaaatataattattaactctaaaattgttttcgtatttttccagcttcactgaagtataattgacaaataaaaattgtatatatttagatgtatttgatgttttgatatacattgtgaactaatctccacaatctaattaacatatccatcacctcacctacttgccattttctttgctgattttatggtaaaaacattttttaaaaatgaaagccacatgaaatggacttactccatgagatagtgtattaggtcaattaataaggaagaagtacattttaataatatggattatattcagttataaaatttggaagcatacatcatgacacccttgactcatttattttttcaagcagcctacaccaaagaaaaatcatactgggtttttcattatggttcataccctacaggtggctctcaatctctttccttgttagtacagtattattgaatcaccctttcctgctcgtaatttatttgtgttattttttaaatttggtctctaaataagacaaatgtttatgacctctgttaatcagcattgcaattatatctatatatttatatacttatatgaatacgtaaaactggaaatttggatttatactgaaaaagtcacagaataattgcattatggtcatgaacactcatttccaaaaaaaagtggtatggagttgtttctctgtttctaaaccccatctcagctctggagatggatggtactccttggaacattctagagtctctacccaagagctccttgagcaactgagaaagaggtggagccaactctcggaaacctttgcagcctaggttacccgcatcactcttctggggtcattaccgcttgggcgctcattttgagaggcttcagaccaagcttaaaagaccatgagttacagtcgccttcctcccaatgtcgaaggcatgacttccctcaaggtggacaacctgaccaaccgcacgtcggccaacaccctgcgagctgtgttcaagaagtatgggagcatgggcgacgtgtacatcccctgggatcgcatcactagacagtcccgccgcttcaccttcatcctcttccacttcaagcaccaggtcgaggatgccatggacgctctcgacgggatcatgctgatggccaagagctttgtgtgcaggtggcacgccatggtcatcccccacgtttctaccgtaacttccgccgggtaacgtcttctagcaggtatgagggagacaactacaaacgccagaggctcagccgaaggcgtcgtcatcccagccgttcctgtagcaggggccgatctggatcccagcggcagatctcccttcagcagctcgaagtcgaagtcctctcactagagtcgaggtcccctcactccaagtcgaagttctctcgctcacgcacgcgctcgggcactcgctcttgcagccgctcttgcactcactctccatcaacctctggatctggatctacccgaaaatccaaattcaattcctcttcagtgtctggatcttgtttgctgactgggtccagctcctggtccagaagcctcccaccaggatacaagaaggaatgcaagtctagatggctatccaagaatgcctccaagcatcgtgaataggaaggagtggtatcattaaccattagattaatcattcatcagcaagcaatctgaggactgggtaggggagtatacttagttgattgatgagtccttggaacaagccactaacaattgcatagtttgttttgtaaaatgtataaccttttacttgttttaagccttgcctcaggtgatacatttcattttatgtggcattttgttgcttttatttgagtaataatatttgaatatcttgtaaattggtgaggtgaaatacttcagttctgatcattggtttggatatttgaagtaaaattgcatttttggccaggtggggggactcacgcctgtaatcccagcactttgggaggccgaggcgggtggatcactaggtcaggagatcgagaccatcttagctaacacgttgaaaccccgtctctactaaaaatacaaaaaattagccaagcgtggtggtggacgcctgttgtcccagctactcgggaggctgaggcgggagaatggcgtgaatccgggaggcggagcttgcagtgagccgagatcgtgccactgcactccagcctgggcgacagagcaaagactccaccgtcacagaaaaaataaaaattcattttcattaaagtgctgactttttttatttgaatgtaaaccgattgttaacctaatttgtggcctcttgatttaagaaaatgtgtatagccacttcatgttgaataatccaaaatggtatagtgattaactctttattgccttcattctttaaaattaaacacctaggtaagttgttatgaatttattcccatgtgctatttattgttaggtctaaatggtaatctgaacccacatttgtaagaaaacattacaggtgaaaagaattgattttttaaagtattatttatcaatgcaatttaatatcttatgtacttttgtgtactgcacagttctacagcagttgagtaatgttaggtggctgttaaggtgatgtttcgcaatgcagagtgcttggctattttattttttttcctggttgctcctatgctgggcagaaacaaaggatggtccagttcattataagtctgacaactacatttccagtcacccaggccatggacatatctatctatctatatgaaacagagcatacaatgagtacatttagctaataataatacatctttattttttcctgtcacccctaaaacggtaaatgtgatcattttcatttgtaaatttgaatatgaaaaatattttttaaaagcaaactatagctctaagtactggtaacatcatccgttgttttgttttgtcttttactgacgcatattctgtactagccactttctgaagtttaatgaaaatgtttttcttggtgttttaaaacattaagttcattgattatactcttatctatgaaactgtgaaataaaaatccactgatgttatccattttaaatgtcttatgaactataatttatcaagaaaacagagttccaagcttcagagacccaaagtgtaaatattttaatttagcagctaccctcagtgtctcacatatctgctactgccttatggctttttttcccaaggctgtcgtgacctcccactggctcagatctgaatcttcttaacttcccttctatgcctcaatacaccatttcaacttactggctttaagttaatggaagacagttcatcctagcttgactttggagttggggctggcactgaatcccttgcttctctttgaactcagcatttgctggtactacttctagccccattcaaccttttctcttgactttatggtggtcaattcaattcccactgccccattccctttgtctgagccactgattaaatcaaactttgaaaaatacattcaacctgctcacattacagtttatgtaactagagtctagaaacattaaatgattgaacaactactggtggtaggcttcaacttccgtctcaattctcaacccaactctctttcctatacattgaattacttcagtgtattgtctctgaatacaatgaattgaaatgatgtttgggaacattattcgtgatggttgggaccaaatattaaacacaagatttaaaaatagtcaagaagtgtaatgtagcagggcctcaaagtttgagaggaagagatttcccattgcagaggaaatttcaaaacttaagtctactataactagcagccagagatgacactgaagttaatggttattaacctaaccaaacatctgttttaatttttcaagacatacataccacacatatatgcacagacaagcacacacacctcctcacactctttgagattttggtaaacttaggcatcttaaaaatcccaccgggggctaattggtcacataacatgatctcactctttattaaggtattagtcgaagacatttcatttcccaccaggactgttttctttcttaatataaaccaaatgttctctggtactttacttcagaatattttctcttcatttcagaattaaatgagtattattttgccaaggttttaaaatacagtgtatgataatatgaaacaaatacaaaaacggaaattttgaaaggaccgcatggtacagagaagtaggaaatttatttaatggaattaacattatatgtcatgaccacgtttagtttataattaaatgaacgagtttgttcatttcttccaactcaattatactaaattgtggtgcctaacaaatatgtattaaacaaatgattagcagaataatttattggtttttaaaattattttcatacaaactaaacccaattcagatataaattatataaacatattaactttatagaatggacaaaagcaagtaagttttacatgacaaatttattaaaaattacttcatgagttctgatcatatcactctcctgttgcaactattaggacccttccttgttaatgacggaattcttcagaagcttacacttaaaatatggaatacattggcttacagatctaaaaatcctaaggcacatctagcttcaggcatctctcctaatttctctcctttatctctctttctatttgttttcctgtgtctctttatgttggcattcctcatttcagaaaaagaagatagccagaagcatctttaggtttatatcctaccaggttagaaactacagtagaacataatttctcattttcaatagttctagctaacatctcgcacttaacccttaatttaactgctttaggttacatgctcatgcttaaccaattaccattaccagcattgtgagacagctgattggacatggctgggtaacgtgtccatttcttgagccattgctgtaaattcagctgcgttgaaaccacctgccccaagattgaactattagtttttccctgtggaaaatcaggctgctgttatgactatggtaaatggatgcttaaacagcgggaaaaaaaactctgctgcttgttctaaaaaaataacaaaatgtcctaatttgtgtcttctttcatgcaggaataaatcaaaactcagtttgttgtctttgtcagttgttccttcttggtttcatttcacatttccacctcagccccaaagttgtagccactgtttcccaggacaaaccagggtctttcaagtctgttccttctgtctgatatcgtttctctcaaccaaaatatgcctaactggcacttgctatctgtagaaaaccataattatctttaaagattcagatttaaatgtaatatctctgtgaaatgtttcccaactcccattacataaccaatgccaatcagttgtctgtacttacacaatactacatatatacatgtttgatagcctaaatatattgtgttttgataattttatgtgatgtttccatcatatagtatatgaattatttagagtttacactgttgcaacatatgatgtctctctatttactaggacataatgggctaagtttatgttggatggattaatttattaactatgtcaaattacataactcataccaatttcagtagccaaatcttgcccatataggaacaactaaaatgaaggattaaaacaagtgtccagtagggctggtaatatggatgagggcagaatcacttagaggtctactttttttttttttttttgagatggagtcttgctctgttgcccaggctggatggagtgcagtggctcgatctcagctcaccgcaacctccgcttcccaggttcaagtgattctcctgcctcaccctcccgagtagctgggattacaggtgcccaccaccacgcctgtctaatttttatatttttagtagagacggggtttcatcatgctggccaggctggtcttgaaccctgacctcaggtgatccacccgcctcagcctcagatagcattggtaaggagtactatcttcaccctgccatcctggctgcactgacacacatggaacaaaatcagcaaagtcagcactcattaatgtaggtgaattattatggatctgtttagaaagtgcctgttacattctggttagctttgtttcaatatttataatatttaagagaaaggaaacataaaatggaaataaatgcctttgtggagaattccttcaggaattatcttgcccaagagttttaacagagcttgatggattgtggaatgtaagatgaaatcattaagagtttaaagtgattggttttttgttcttgcgatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttattctcactcataggtgggaactgaacaatgagatcacatggacacaggaaggggaatatcacactctggggactgtggtggggtggggggaggggggagggatagcattgggatatatacctaatgctagatgacgagttagtgggtgcagcgcaccagcatggcacatgtatacatatgtaactaacctgcacaatgtgcacatgtaccctaaaacttaaagtataataaaaaaaaaaaagaaaaaaaaaaagagtttaaagtgaaaggactccactgaagagattcagctccggctctggtgaattatcaaaaagtgtgggctttcatagtgatcttctatgattcaagggatccatccatgagaagtccctgggcacctgaaatgtgaattactgcctgtaactaggatgacttggcatggcaatttggaaaagtcaggctatgtaatggaactagctgctttcgagttctgcaatgtagattacaaataactggagcacattagagcctgaaaaagccctttggaagcctgagaataggctcaagtgggtagaaggaggtgaagaacagttcctggaactgcataaactctcagcaatatttgctacttttgcataaaataaaatctaacctgaggcagggcgcagtggctcatgcctctaagcccagcacttcgggaggccgagatgggcagatcacctgaggtcaggaattcgagaccagcctggccaacatagtgaaaccccgtctctactaaaaatacaaaaattagcggggcgttgtggcacgcacctgtagtctcagctacttgggagacagaggcaggagaatcgcttgaacccaggaggtggaggttgccgtgagccgagatcgtgctactgcacaccagcctatgcgacagagcgagactccatcaaaaaaaaaaaaaaaaaaaaacctaacctgagtacagtgtcaccttggtagcaatggggaagataatggacgcctaggcaacaggcaacagcttctatcaggcactgagctagagacctgtctcagcctaggactcaccagtagctgaagagctgcaggaccacctgagacctaagggggaggaggagcctatgagaaggtggaaatgactgagtggtatcctgcctctcagaaaaagcaccaactacgcacaactaaagcccacctggtactttaacactacaatctcattggcatatatagaacaattgaacaaacaacagcagaatacacatttttccagaatccatgaaatattcacccagatagaatatattttcaatcattaaacataccttttcaagcttaagataattgaaatcatacagagaatgttgcctgctcataataaaatctaactagaaatcagtatcagaatgaaaacaagaaattttctaaacatagagattaataaacatacatccaaataatctctaggaaaaggaaatgatcccaaagtaaaataaaaattacacaccactgaatgataacgaaactcgaaagtattatgataaatgttaatgcaactaaagcaacaatgaaaggaaaattcatagcatgatatgtttagattgaaaaataaaaggttccaaatcaataatctaagttttttcctcaaaaaattagaataagttgagcaaaataaacaaaaagcaaacataaggaaataaataatacagacaagaaattattcatatctaaaacagaaaaacaatagagaaatgaaacacaaagctgtttctttgaaaaatttggacaaaatttaaaagcctctaacaaagctggcaaaatgaaacaccgacacacacacacacacacacacacacacacacacccaatatcagggttgaaaatgagaatatcactaaagatcctgcagccatttaaacgactataaacaaatattgcaaaaaaatttacactcataaattcaatgacttagaataaatggatcaatttctcaaaaactgtatcaatatcaataccctgcttgtaatactgtactatagctttgccagattttaacatttgggaaaactaaactatgaacagaatttctctgtattatttcttacaatagcatgtgaatccatactcatcacatcacccccccgaatatttactttttaagagaaaccttttttttttttttttggagacggagtctcgctctcacccaggctggagtgcagtggtgcgatctgggctcactgcaagctccgcctcccaggttcacgccattctcctgcctcagcctcccgagtagctgggactacaggcacccgctaccatgcctggctaatttttttgtatttttagtagagacggggtttcaccatgttagccaggatggtctcgatctcctgacctcgtgatccgcccgcctcggcctcccaaagtgctgggattacaggcgtgagccaccgcgcccggccagagaaatcttttttaaaaagacttgaaaggtaagggagattcaaaatgagaatctccattgctgcctttgaaggtggtgggagccacatagcaaggacttgctaatggcctctaagagctgagggtaaacctcggccaacagccagcaagaaaacagtgacctcagttctatagtcacaaggaactgaattctactaactacctaaatgagcttggaagtgggttcttccttagtcccctagatgagaataccaccgatttcaggcctataagaccttgaagagagatctagtaaaaccttgccagtattctgacctataacactgtaaattaataaagagatgttgttttaagccattaagtttgtgataattccatatgcgagaatagaagactaatacaacttctcacctaggatctttcctgtgtctaggcaaagagtaaatttgagtcctagtcaagtaaatggctcaatgtcttggttctaggtgtactctgaccttattattgtgatggtactgcagaaaatgcagttcttgacttttgacttaatttttttcattcactcttttcatttgttcattctttctttcctttttctttttcttttcttttttttttttttttttttttttttgtagagaatgggtttcgccatgttgaccaggctggtctggaattcctggatccgcttgtgttggcctgccaaagtgctgggattacaggcctgagccaccacatccagcctaaattcttgaactttgagaattattttccactagaatagaatccgttcctaattcctaatgttgaaggtccaagtagacaatgtccttcccatgtaaacattcactaatatctcctctctctgaccttacttcacataaacctatccaaccttatcagtgtatgctactcgtatcaaaattctgattgaataccctggctttcaaattatggagcctgctatattttgctttaaagcaattgttgagtattataatgacccccaaatcatatctacccttctaaatacaaaaagtagagaatatttgtacctgaatcttcaagcaccatctaatctttgtttattatgttaaaatctatcagtttaaatctatagcattgattctactagtaattttaagcctatttccttcttaagaattttcttatattttatttttttaattttatttattcatttattatttttaaatttatatttatttatgttgacctaattacaaaatactaaaccttatctgattaataaattctttctgaaagaaattatagatcatggatagggtgtttgatagcaatgtaaaatacattctttttggctaaccatgattaaaaaaaaagtatgtcctacatcttccacaaaaaaaataaatatagagattttgccatagttgctgtaaaacttgactgcctaccaatatgaacattattagccctgtacatacttgcagttttacaaagaaatgagatgtctctcttgagtaatgttaccttatataaatttccttttatttcttctgtatctttatcttcaaaatattctttaaaataagtaaccaagcattttacatgtttccaatgtatgagagggcagtgtttgtatcccttccatgagaagttttctggtttgagtctttgaatggaaatctgacttgtattgtttttctgtcacttcatttaagatttgaaagttctttcttatctcagaccttttcatcatggaacaataagagaatctcttttgtgtgacacttgagactccctttttagtcattaaacagtgtctttaacatcacttcaaaatctttggatgcttggacagcatttgcagaaaattcatttttccctcatccatcattcttccaggactgagactattcatcagccaactgtgagttttgggttttccattctgacatcactagtcatgaagaagcaaccaacccctgtccttgttgtcatctattaggataatgtatttctttttttagtagcacttgtgactacctaaagtagatttattatttatcttgtgcttgtttcttttgccactctgacctcaaaataaaagttccaaaacactcttttgttgttgtaacgaatactacaattctaaagactagcccagcttattgcatacagtatatattcaattattacatgtcaaatgagtaaaaattcttccgtagaaactttttggttctgtttcagaatgtttggctgatgtcagcatatatacttatttttaccctttactctctaaagaaaattcagtttcatattattacctagcattctggatttgatctacttcagcctatacttctcttacttagttaacatatttgcatggtatctcttgcctgttaagttaaaatatctgccaaattgattccaaactagtagttcctgcattcaacacttataatccttactgagaatatggcaggccagctgctggatgctagggatggagttaggaactggagtgtttatcatgaagaaatgggttgaattttaacgaaggaagtgaataaacatataatgaccctctgtgtgatagatgccctgatagagattcagacacaccgtgtaatggaatgatgttgaaagagtggttcacagtaataaaaggtcaaatctccctaaatttagatgatacctgaaatgtatcttataggactagtagcaactaggtaatggaatgaggacatgaattttattctaaaccaagtgaacaatgcacgccacagtagagatgcatattcagggagcagtaaacaaaacactttgactcaatcatcatagtctggggtaggagaggaagaggtctgaatactttagcaaaagatgaagagatgaggccacagaggtaataagtggccttgtctatcatgctaaagggctgaattagatcttctacacaatgcatagcccatgtgattttagtaataggaataaaaagattcgatttttgcaattaccatactagagcagaggtgtgaaaaatagattgtagccaagttaattgtcccacttatggagtggtggcattaattagatgaaaaatatataaagtcttgaaataaggctgtggtagttgggatgtgtattgtatggaaacagatttaagaaataataaagaagcagggtcaagcaaatttggtgactgcttggatgatttaaagataaccccaaatgtatgatttaggtgactgtatggattgtgggaggctccactatcataacaaattgagcacacttggtttgtcacagtagagacagagatgttaattcagctgggatctctgagattggagattcagaatcaggttgagtgtcaatgtctatctagctatgaggaaacatcaagtatgcttataaaattagaataaagatgctaattgaaatcaaagaagtagaaaatattgcctgtacaagtatgttcagtggtaatagaggaggaaaatggatacaatcccttggaacaggagcaattacaaggtagacagagggaaaggaaagagaaaagataaccaagataggaaacaaaagaggagagagaaaagctcaataatgtaacataagcctcccaaaatagaatactttcagaagaagaggacgtcaagagtccactgaaagaaatttctttagcttaaaaatagttaaatatcttttaaaaaattaaaacactctattggaaacatgattttaaataaatgcctagaattctgctatatggctataaatcccatttattagaaattagaatacagttgaacatttaatgtttatttatttttgctgtcttacacaccactgaagaaatccttgtggatatgtacatatattctctgaaaagaaatttacagttgtaaatattaccaagtaaaaagctatcaactgtttcaaggcttttgatatacaggccagaatgtcaaaagaaattaacaatttactttcactccaacaattttcaaggttttccaagcagtatgttattaccaatgttgtcttttatatcacagcaaacaacaaaggcaatagcacacatgtatcaaaatatcccacgtcacccaataaaattcacaattaattataaacaaaataaaattttaaaaagcaattttcaactactccaaaaagaaatatttatcaaaataatagacaaaatatttattgctttaattttaatttatttgatttgtagtgaggctaaatttgtcaaatcacaattgaaactggtcaatttcctggttgttacttgccatcttttaaaatggcgtgatagtttttttcttattttgtaataaatcatatcaattttaaatatgtatctatacttatgtattttatatctacactcaaaatataatatatagatattgttattaccttgtcaaaaagcttgcttgtgtgttgtagtttgttatctgcctttataattttataattctgttaatttcctgtgagtaatacaacacaatgttaaatctattattttttcatgactatttcttctcttgcttatatacataaaatagacataaaaggtaattcatcatttagaaatttgataaataaatgaatattttatctaatttaggaattagataaaaatttaatttttaaaatttatataatatttttatttaactctttaatccttctgaaatgtatgtattgattctcaggtagaaattccctagttaacatggtatagtattgagactcatatctagcaccctcttaatgcttctaattaaatagtaattctaccaatgttctaatattaaatgtaaaattgctaatttgtttaaagaagatactctccattatgttaaaaaaagtgttactatagaaagatatcagaaattacagaaataaatggaaaatcattctatgcttatggactgaaagaatcaatatcgctcaaagcaatttatagattctaggctattccaatcaacctaccaacatcattcttcacagaactagaaaaaaaaagattctaaaatgtatatagaaccaaaaaaagggcactaatagcaatcctaagcaaaaagaacaaagccaggagcatcacactatcgggctttaaagctacaataaccaaaatggcatggtgcagacacaaaaacaaacacatagaccaacaaaacagaacagaaaactcagaaataaagccaaatacatacaaccaccttgtcttcgatgaggccaacaaaaacaagcaatggggaaaggacttcctattcagtatatggtgctgtgatagctgtctagccatacgcagaaaaatgaaacttgattcttatacctcttatcatacacaaaaattaactcaagatagattaaagatttaaatgtaagacctcaaactataaaaatcctagaagaaaacctaggaaatgcccttctcaacactggccttggcaaagaatttttggctaagtccccaaaagcaacggcaataaaaacaaaaattgacaagtgggacctagttaaactaaagaacttctgcacagcagaagacagtatcaacagagtaaacagataacctacagaatcagagaaaacatttgcaaactatgaatccaactaaggtctgagatctagaatctatagggaacttaaaccaacaagcaaaaacaaagaactgcattgaaaaatggtcaaagaacatgaaaaaacgcttctcaagaggacatacaagcagccaacagaagcaaatcaaaaccacaatgagataccattgcacactagtcagaatgactattactaaaaagtcaaaaaacaacagatgctggtgaggctacagagaaaagggaatgcttatatacaattgctggggatgtaaactagttcagtcactgtggaaagcagtttggtgatttctcaaagaatttaaaacagagctactgttcaacccagcaatcccattactaggcatatatccaaaggaaactagatcattatgccaaaaaaaaaaccacatatgcactcatatgttcatcacagcagtattcacaatagcaaagacatggaatcaaccttggtgttcgtccatggtggactggataaagaaaatgtggtacacgtaccatgggatactacagagcgataaaaaatgaaatcatgtcctttgcagcaacatgaatggagctggatgtcataatcttaagtgaactaatgcaggaacagaaatccaaataccccacgttttcacttataagtgggagctgaacattgagcacacacggacataaatatgggaagagtaggtactgtggactactagaagcaggagggagagagaggagtaaagcatgggttgataaattaattattaggaagggggcaatatgccctgtgacaaacctacacatgtacccccgtatctaaaacaaattatgtaatttgtaaaaaattatatattccaaaggaaaaaagatgtcagtcatttacagcttaagactggaaactgatgttaaattttgcaaaaatgactgttgggaatgtattatggctgattaaattattagcagtattatttttgttgctcctgaattagtagaataaaccttgtttgggtttgtttttctacagtttcaaattggcctccagttttaattaatgtattaggtgctaatgtcagaattttcttctttctgtaaaataaatttgaattttttcccaaaaatctcagttgtaatttttatgatttgagaattatttgttctttgaccattatttatttcttacttattaaggaaaacactatattcagagttgtttgtatttatttattggatcatttatcagtctctttcatgatggttttcaactttctttggttgtctccttgaggagcttaacaatcaaccttctgaattctttttcttgtgtttcaatgactttatcttggttggattccattaactggagaggtagtatgatattttgggggtgttatagaaccatgatttttcatattactagtgtcacttttctggttcctcctcatttgggtagagtatttcttctaattattcttaaatttatgtttgatttgactttaaaaaaatttttccccttaaggatgtgactttaatgcttatagttaattataccctaattcaattcttggtgctttcatgagtgaatactgagtaagaattcctaggttatagagcatctttgtatgatagctttctcacatgctggttgtagtagcaatgtgcttgctgtgtgagcaagttcactttctcctacggggttggaatggtagaggtctcctgaaggttatctcattcccttgtggcatgtactttttaaatttatttttttttcagcattttacttactgctttgatggttcaggcattaggtcagtaggggaggtgtccctgggtaggaacaggttgtgggtaaagtagatgggtaaattcaatagccagtggtgggcaaaggtaacagcattgatagaagtggctgggggagctctcagtgagtctctctgagttctcatcagagggaagggttggagccacctcagctcccctgccaagtcagcaggaaagctattcacctctcagacatattgctgtcccagtggtctggctatgtagatctgacgggcaccatttttcatctgtagaaaagttaatgttccaagcagagagaaattatgactctgtctcttgtgcaaacctgaacgtggaggatgctcctcttgaggagatgcagttacccagaagttctccagaaaggttgttaatagctgtagccatgctgagctcctgtgggagaagccctgatatggtttggctgtgtccccactcaaatcccatcttgaattacagctctcacaattcccaagtgtcacgggagggacccagtgggaggtaattgaatcacgggggtgggcatttcccatgctgttctcgtgatagtgaataagtctcatgagatctgatggttttataaagaggagttcccctgaacaagttctctgttccatgccatcatataagatgtgacttgctcctccttggcttccaccatgattgtgaggtctccccagccatgtggaatggtgagtcaattaaacatcttttctttataaattatccaggtatgtctttatcagaaacatgaaagcagattaatacaagccgcaactctgcctgtgttgttgatgaaagagtggggaaagacatcccttctccaagacccttcacgtgcaccagggctgtctgattgttcatcactgcaacagtgcctctgctgaaatatatttcccaccagtggaaagatctggtgctcaaggctttccatctaattattttttgtcccagtggggtgttcccttgatgtggtgcactaccccttaccctgggagtgggagtccctgggaaccagactactgtgaattttgtggctcctctgggtctagctatctagtgaagttgccccactccagattgatgctgaggaatgtctgtaagggatccggtgatgtgagctttcctcatgtctcccagtggtgaatagcctcccagtggttatacacagccttagagtgttggctttttcaaacaccagttatagcaacaatgaaatagtcatgtggacggactcaggacctcctggttagccagagttgtgtaagcagttgtgatagctgaggtcacgcagttgttttctcctgcctgtgtgcagtgttattccaccagaagatgctgtaatggactgtgttggttgatcttcagccaggaggtgacacttacaaaagagcaccagctgtgctattagtagtggggtttttcttgccttgtgcttcccaggggtggggtactctggtttattaggcaattggcaggaccatatcactccccaaagttcctttgtgttaagctaccagggcaaacgtcagggcaaagtcaggtgagggctgggtcaggcgggtttgcactctgaccctctgtgttcagaacaagcaccagcccttgcgggtgtttgggaaatggaagcagttcccaggccacttggatgatgtccagaggggagtgtttctccctctgctgcacagaagagttcatgcagggagtggggagtagcaggaggaggtaagtccctcacagatcccacacactacgtgaggcatatctacttctgcagtgttccactggcagcaatgagctaagtttcaggtcagtctgcactcaaaacttgcaactgtcccaggtcataagctatacatgtggaaatagcaactgtggcattcaggccatgcccctccctgtctgccctgcaaagctaggtgcctggctcctgcactcgtggctgcagcccactttttgctcaccacccccattatctccaccaaaggttatatcatgaaacccggttgaaggcttctttcaacctgcaaccacagcctgaactatttatttggctgaactccgcaaggtcaactgtgaggaacaataaggaacggtttccctcagtccacgctagagattggtagtgcacgcaagggtcttcgcgctgctgctcctacttttatattccatgaccctactcaagtcagttcctgtgctgggtagggttcgtgccttcttccacggcctggaattgtaggatctccagtgagaatgtatatcccggaggcagtttcaccccctctcacacaccctgactacttgtagcccctctgattcacagtgtaggcagcaggctgctgtttccttcaaagggtctgtaaatgcctttggttttcctgttcagttcctgcatttcttcttgaaaaaatgttcatagtgtgaaccccacccctgggaagcataaggaaatacacaccattttgtcctttcaagtgggagaggtatgctagcaatgtctgtaatctgcaatcttggaaaaaaaagaattacttttcatacagtatcattttaacttgttatggatataatgttttatcatatttttctaatatgaattttctagctcttttctatttcctgaatatgcttgtttctcccaggatttgtttcactgggtttttaaaatatttatcttattctcttttgtgtcacacctctctcaaatatttcagtaaacacttatggagcacctactctgggcaggccagtattctgagtgcaacaataatgtagtgaaaaatacaaaatctttgctttctatgaagttacattcttcttgacatctaacaatgttttgttttgtattcacagtcaaggatgagaaccatgagctctgattatgtggttagagtttggcttctgaaatgcttacttttcctatgaaaatagtggagatctgccactactctgaatatctacaaatgttgaaagaatgaggttttgttctgaggacctaacaaccaccctaagcattgtagttctacctggagatagtgttttcatttctaaaaaaaaaaaaaaaaaaaaaaacaaccctttaaaaataagcattggtaaatgaatagttaaatgtcattctgtcaggaattttgcttgagagaaaagctataaaggttaagtgagtgactctgttacacatagactttcagtctacttctccctcttgacatcctgagctattcagaccttcttttgggcagatatacatcgccgaagctgtagccctttccttgtatattttaggaggggtttctttttctttcaaatttcagaattatttatcttcagaggcaaaggtaatggctgtgtatgaccagccaacaaacatcttgaaccagtgcctactttttttgtattttttaaaaatccaatataaattaattttataattcagcaatagggagtttcagaggtttcattttttcatttttttcttttcttttatttatttatttatttatttatttatttatttacttatttattgagacaggatctcactctatcacccaggctggagtgcagtagagtgatcacagctcactgcagccaggacctcatgagctcaaacaatctcatgtagctgggactacaggtgcacaccatcacactgtgctaatttctttattttttgtagagacaggttaccgtcatgtttcccaggctggtctcaaacacctgggctcaagcaatctacctgctttggcctcccaaagtgctgggattacaggtgtgacccaacatgaccggctgactttcagagtttttaaacttgaaaaaggatatacccatcacttcatttttatgacaaaagtcacttatttaaatcttaggcacttgttactatgataattgtattaatcaaaaggtttattattcagaaattataattttagcgaactctttacaaattatttaaaaatcaaaatgaatttagtgactcataatactccaaagtttgggggcagtgctgatagcttcagatgcaggtgtgtgaatacaaaagtgaatagaaagtgttttctttgacttagatgttttcctctctgaaggttgtttttctttttaagtcgttatccaaaggatgagaatgataaatgactaatatccactctacttttatacattaacaattcactgaacatactgaaagagagagccttcatccaaaatactgacttagtttggaatttcttttcaaacctgaagggtaagaaacactaatgtgccaggtcttagtcacatgtgcaacattaaaatatggaggtgggatccccccaaaccaaaccagatggacatgtgggcgaatcatgaaaggtagcaatataggtcctctaacaaatatggttcttttttttgtttttcactctcttcttgaatgaattctgataatatatattttactagaaaatgatccatttcatccaggggtttggatttttatagtgtatttatgttcaacacattatgctaaaatcaatgtatttactcctatattttttgtttcctctctcgttcccacatcttatattttgtctttccctctttttttcaattagactaatgatagtatataatctccatcttagggtttgatcagagaagtagaaccacaataggaatatattttagaaattagagctggtatgatagtggggatttgttaaacagtttatgtaagtccattgccccagcgtgtggtgctgacacagaagttagcagggccagcagtcaggaaggagagatggtttgaaatggagacataaggataacctggaacctgcaaagatgagctgcaatccatttaatgaactaaatccaacaacacattaaaaggattatataccatgactgtgatcaatatatatttaatctttgttcccacttcctggcacacagctcctaaaaaaatccttgtaatctccatagtaatgagtgactggctgagtgcggtggctcacgcctgtaatcccagcatcccagcattttgggaggcccaggtgggtggatcacctgaggtcaggagttcgaaaccagtctgaccaacatagtggaaccccataatcccagcactttgggaggctgagatgggcagatcacgaggtcaggagagcgagaccatcctggctaacatggtgaaaccccgtctctactaaaaatacaaaaaattagacaggcgtggtggtgggtgcctgtagtcccagctactcgggaggctgaggcaggagaatggcgtgaacctgggaggcggagcttgcagggagccggggtcgtgccactgcactccagcctgggcgacagagcaagactctgtctcaaaaaaaaaaaaaaaatacaaaatacaaaaactagctgggtgtggtgatgcatgcctgtaatcccaactactcaggaggctgaagcaggagaattgcttgaatctgggaggcagaggctgcagtgagctgagattatgccattgcgctccagcctgggcaacaagagcgaaactccatctcaaaaagcaaacaaacaaaaaacaaataaaagactgacttacgtatgctagtaagatgattagtggctaggagcccctagttagcttcagggtgagtgctggtcacaagaaagaccaaggcataattaaagggttgaaactttaagccccactgtgtgatcgtctcagaagagaggattggagattgagttaactacaaatggccagtgatttaatcactcatgcctacctaatggaaactctataaaatgacaatgttgagagagcttcccggttggtgtacattaagatgttgagagggtggcatatgcagagagggtgtggaagctctgtgtaaccctcctctctgatactttgtcctatgcatctcttccatttggtgttcttaagttgtatcttttataataaactggaaatagtaagtaaaaacactttcctgagttctgtgagccactctagcaaattgtttaacgtgaggatgggattgtggaaacccccatcacaacttcatagccagttcaaaaatacaggtggccaggactcgcagttggcatcttcagtgggagcagtgttgtgaaactaagctcataaacttgtggagtttatgctaactccaggtagtgtgttagaattaaatggaattgtaggacacagatatggtttggatttgtgtccctgcccaaatctcatgtcaaattgtaatacccagtgttggaggaggggcctggtgggaggtgactggctcatgggggcagattcctcccttgcagttctcatgaaagtgagtgagttttcactagatccggttgcttaaaagtgtgtagcacttccccattctctctcttccttcttctccgaccatgtaagatgtgcctgctttcccttcaccttctgccatgattgtgtttcctgatccctccccagccatgcttcctatacaatctgcaggactgtgtgtcaattaaacctcttttctttataaattacccagtctcaggtaattctttacagcaatgcgagaatggactaatacagacaccaagttgataaccaaagagttggaaaattgtttgctctgggggaaaaaaccccacacatttggtgagagaagtattacaagtaaaaatagatcaatgatcaggtggggtttattcctgggatgcaagggtaattgaatatacaaagtcaatcaatgcaatatgccaaattaatagaaggaagaacaaaagccacacaatcaccttaaatgatcctgaaaaatatttgacaaatttcaacacactttcatgataaaaagagctaacaaaataggaatagaagggaattttctaaatataatgaaggccaaatgtgaaaagcccacagctttgataacataacatgatcttatatgtaaaaaaccctaaagatttcacaaaaaagtagaactaataaataaattaaataaagctgcaggatacaaaatcaacacacaaaaatcacttgcatttctatatgttgacaagtaataatatgaaaaggaaattttaaaaattcccatttacagtagcatcaaatagaataaaatacttagtataaactttactgaagaggtagaaaggctgataagctgaacactgtaaaacagtgatgaaataaactaaggaatatataaatacatggaaacagatttcttatgaattggaagacttaatattgtcaaaatgtccttactacccaaagagacctacagattcaatgggattcttatcaaaatcccaatggcattttttgcaaaaatagaaaagaaattctaaaatgtatatgaattctcattgaatcccaaatagccaaaattatcttgagaaagaaaaacaaactggaggcctcatacatccaaatttcaaaacatattacaaagctactgtaatcaaaacacaatggaactggcataaagacagagatatagaccaaagcacagaatagagttcaagaataaactgtcatgtatatggtcaaattatccttggcaaaggtgcctagtacacaatggaaaaagcaaaatttcttcaacaaatgatcctggaaaaactggacatccacatgaagaataatgaactgtgactcttaccttttaccatatatagaaattaactcaaaatggattaacaagccaaatgtaagggccaaaactataaaactgttacaaataaacatggaaaaggctttatgactctgaacttggcaatgttttcttgaataaaacaccaaaagtacaggcatcaaacacagaactacacaaatgagactatatcaaacttgaaaacttctccataacaaaggaaacaatcaacagagtaaaaaggcaacctatggaatgagagaaagtatttgcaaatccatatatctgataagaggttaatatctagaatgtatcaagaactcttacaactcaacaaagaaaattaaataatccagtataaaaatggacaaaggacttgacatttctcccaagataatatacaaatgaccaacaatatatgaaaagatgctcaacatcactaaccatcagggaaatgcaaaatgaaactaaaggggatatcactgcacacctattaggatggccactatcaaaaaatcctcacgtttgtgaggatagggataaattggaacccttgtacactgttggtgggaatgtaaaatgttgcaactgctatggaaaccattttggagggtcctcaaaaaataaaaataggatcaccacataatctagcaattctacttctgagtatatatccaaaataattgaaaacaggatcttggagaaagtgcaagatattcgactagaagcagctaaggtgcacttctctcaaggagagaaatagaaggggtgagtaaatacagcactttcaactgaagcattcaggtacatgcattgggattcatcaagaaaacaactcaacccatggagaacagagaaagcaaggcagaacgacctctcacccaggaacaacacggagccagggaagcctcccatataagggaagcggtgagtgagtgagtgagtgaccctggggaccagcatttctcccacgaatctttgcaaccctcaagtcaggagatttccttgtgaactccatccaccagggccttcaatctcacatacagagatatgaagtgtcctagcagagcagccgctcaggcacattcaaatccctgggagctttaaatacatgggcttcctggcaaaagcagctgcaactccagcaaagtaggaggttagacccatatattacccccctccccccagaaaatgggctgaatccagagggctcagcagcaacggtctgcaggccccacttccacagcaccttgcaggataagacccacgggcttggaactctagtcagccacaggtagcagcattacacctccctaagacagagttgccagaggcagagatggaccacaatctttgctgtttcatagccttagccattgttgccctcaagctccggggaatacaaggcaactagggactggagccatcacccaacatagcactgctactctatgaagggctgtcagactgctttttcatgtgagtcccaaatcctgtttcccttcagagtagaatataccgtctgagttctacaaacacctgtactggtggtttcagaccctggcagcaggtccatacctccctgggatgggactttcagggaaagggacaggctgccatctttgttgtttagcagccttagacattgttgcccttagactctggggaatctaaggtgaccagggactagacagatcactcaaaacagcacagctactctacgaagaggcagccacactacttttccatgtgggtctcagaccctgtttctcttcactaaatggaatcttccaactgagggctgcaaccacccctgcaggtgttttcaggccgacaataggtcagtaattccctgggacgggactcccagagggagggattggtgaccatctttgctgttttgcaaccttagccattgttgccttcaggatttggagaatctgaggtgacaggggctggatcagacacccaacacagcacagctgccctatgaaaaagcagccagactgttttttttatgcaggcctctgatcctattcctcctcattgagtggaaccttccaacctgggttgccacgtacccccatcagtgtgttcaggagggagggaaacaactctgtacctccctgggagggagctcccagagaaaggggaaggccgacaactttgctgtttcccaggcttcactgttgataccttcaggtactggaaaatcctaggtgattagggactgaagcgacccccccagcatactgcagcaaccctccaaaaaaagtggccagactgtgttatctgggtcccagatcctgtatctcctcacagggtggagtctgctgggctgagtctccagccaccccacaatggggctatcaagccagtatcagctctgcaacaacctgggacagagctcccaaagaatgcactgggttgccatctttgctgtctcacagccctcacccttactgtcttccaggctctggagagcctgcagggaatatgggctgttccaaaccaccagcacagagcacccatctcacagaaaagtggccagactattctccatgcaggtcctggtcttcacttcttctcactggacagggccacccaacctgggactccagcacaaccaccctgaccccgcctgagcacctcaatcagaggcagcccaacatttcccagaggagaaatcccagatcaacccacaatccccctgacactgcagttgcactggtactgacctaacagccctcaggctgaggaaagaacaaagggtctagtcactaccctggcacctccagaacaccacagtaaccgtacagagaggagtccaactcctctttcttggaaaccctcacccttactcttcagcaggcagggtccccagctcatgacttcagaacagtcacctcactcactgtagagcatacccactggcagtggcccagagtttctgtggggagaggctccaagagtcatccaacagcccctctgccactgccatggaggcagttctattcctgctgcccttggtttggggaagaaacaaagagcctgagtgacacacctaagcttacagcatgcaacagtcatcatatgaagaggagagcagtctcctctcctcccagtgaggttagcccttgaccccctactctctaacaagtaagccccaatctcacatcagcagtgcagctgccccaccccactggctgaacactcccagtaatagcaactctgctttcctcagagatggagccccaggggcaaccaaatgcccctctgccactgcctctgctgtggtactaccctgtaaccctcagactagcaaagggtattgtcctatccacacctccaacaagctgccatcaacccaaggagaagaagccagtctatctcccataggtcccatccaccccttccctgcttgtcatcaggcaggaaatcccaagcttgggcccacagcacagaccctccaccctggattgattgcactgagcaattgctggcctgcatttctctcaggtggagccctcaggagacaagtaaaagacccttggccacagctactgctaaggtccattcctctgctgcctccaaattggggagaaaacataaaccctgaggtcatcccagagctgtggtaggcagcccagaagtgccaagctgtgatctaaagccagcactcaactgggagaggagcctacactttcagagcattgagagggagcaaggttgcaactctgaagaaatataggggaggcacacaactgagcaacagcataccaactgatcactacacctaaatgccacctactggatcacaccctaaagcttcaacaccaaaaatgcctcgctaacatacccccatctgaaaccaaagacaagaagccagcttcaaatgaagaccctgcacaaaggcttggccccgtgaaaacatccagaaaagaagtctattgattctactcaatctacgctgaagttgaagaaacacgcacatgcagagacaagaaagaaccaacacaagaactccagtaactcaactagacagagtgttgtatgtcctccaaatgatcacagcacttctccaaaaagagctcttaaccaggctaaggtggctgaaataacagaaataaaattcagaagatggataaaaatgaagatcattgagattcaggagaatggcaaaaacccaattcagggaaactaagaattacaataaaatgatacagaagctgacagatgaaatagtcaatataaaaaataacctgggatttgggagccaagatggccgaataggaacagctccggtctacagctcccagcgtgagcgacacagaagacgggtgatatctgcatttccatctgaggtaccgggttcatctcactagggagtgccagacactgggtgcaggtcagtgggtgtgcgcaccgtgcgcgagccaaagcagggagaggcattgcctcacctgggaagcgcaaggggtcagggagttcccgaaaatcgggtcactcccacctgaatactgcgcttttccgacgggcttaaaaaaccgcgcaccaggagattatatctcacacctggctcggagggtcctatgcccacagagtctcgctgattgctagcacagcagtctgagatcaaactgcaaggcggcagcgaggctgggggaggggcgcccgtcattgcccaggcttgcttaggtaaacaaagcagcctggaagctggaactgggtggagcccaccacagctcaaggaggcctgcctgcctctgtaggctccacctctgggggcagggcacagacaaacaaaaagacagcagtaacctctgcagacttaaatgtccctctctgacagctttgaagagagcagtggttctcccagcacgcagctggagatctgagaaccggcagactacctcctcaagtgggtccctgacccctgacccccgagcagcctaactgggaggcaccccccagcaggggcagactgacacctcacacggcccggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaacgcagttcctcaccagcaacggaacaaagctggatggagaatgactttgacgagctgagagaagaaggcttcagacgatcaaattactctgagctatgggaggacattcaaaccaaaggcaaagaagttgaaaactttgaaaaaaatttagaagaatgtataactagaataatcaatactaagaagtgcttaaaggagctgatggagctgaaaaccaaggctcaagaactacgtgaagaatgcagaagcctcaggagctgatgcgatcaactggaagaaagggtatcagcgatggaagatgaaatgaatgaaatgaaccgagaagggaagtttagagaaaaaacaataaaaagaaacgagcaaagcctccaagaaatatgggactatgtgaaaagatcaaatctacgtctgattggtgtacctgaaagtgacggggagaatggaaccaagttggaaaacactctgcaggatattatccaggagaacttcgccaatctagcaaggcaggccaacattcagattcaggaaatacagagaaggccacaaacatactcctcgagaagagcaactccaagacacataattgtcagattcaccaaagttgaaatgaaggaaaaattgttaagggcagccagagagaaaggtcgggttaccctcaaagggaagcccatcagactaacagcggatctctcggcagaaaacctacaagccagaagagagtgggggccaatattcaacattcttaaagaaaagaattttcaacccagaatttcatatccagccaaactaagcttcataagtgaaggagaaataaaatactttacagacaagcaaatgctgagagatgttgtcaccaccaagccagccctaaaagagctcctgaaggaagcgctaaacatggaaaggaacaaccggtaccagccgctgcaaaatcatgccaaaatgtaaagactatcgagactaggaagaaactgcatcaattaacgagcaaaataaccagctaacatcataatgacaggatcaaattcacacataacaatattaactttaaatgtaaatggactaaatgctccaattaaaagacacagactggcaaattggataaagagtcaagacccatcagtgttcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaagccattacataatggtaaagggatcaattcaacaagaagagctaactaccctaaatatatatgcacccaatacaggagcacccagattcataaagcaagtcctgagtgacctacaaagagacttagactcccacacattaataatgggagactttaacaccccactgtcaatattagacagatcaacgcgacagaaagttaacaaggatacccaggaattgaactcagctctgcaccaagcggacctaatagacatctacagaactctccaccccaaatcaacagaatatacatttttttcagcaccacaccacacctattccaaaattgaccacatagttgtaagtaaagctctcctcagcaaatgtaaaagaacagaaattataacaaactatctctcagaccacagtgcaatcaaactagaactcaggattaataatctcactcaaaactgctcaactacatggaaactgaacaacctgctcctgaatgactactgggtacataatgaaatgaaggcagaaataaagatgttctttgaaaccaacgagaacaaagacacaacataccagaatctctgggacacattcaaagcagtgtgtagagggaaatttttagcactaaatgcccacaggagaaagcaggaaagatccaaaattgacaccctaacatcacaattaaaagaactagaaaagcaagagcaaacacattcaaaagctagcagaaggcaagaaataactacaatcagagcagaactgaaggaaatagagacacaaaaaacccttcaaaaaattaatgaatccaggagctggttttttgaaaggatcaacaaaattgatagaccactagcaagactaataaagaaaaaaagagagaagaatcaaatagacgcaataaaaaatgataaaggggatatcaccaccaatcccacagaaatacaaactaccatcagagaatactacaaacacctctacgcaaataaactagaaaatccagaagaaatggataaattcctcgacacatacaccctcccaagactaaaccaggaagaagttgaatctctgaatagaccaataacaggagctgaaattgtggcaataatcaatagcttaccaaccaaaaagagtccaggacctgatggattcacagccgaattctaccagaggtacaaggaggaaatggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacattgatgcaaaaatcgtcaataaaatactggcaaaccgaatccagtagcacatcaaaaagcttatccaccatgatcaagtgggcttcatccctgggatgcaatgctggttcaatatatgcaaatcaataaatgtaatccagcatataaacggaaccaaagacaaaaaccacatgattatctcaatagatgcagaaaaggcctttgacaaaattcaacaacccttcatgctaaaaactctcaataaattaggtattgatgggacatatttcaaaataataagagctatctatgacaaacccacagccaatatcatactgaatgagcaaaaactggaagcattccctttgaaaactggcacaagacagggatgtcctctctcaccactcctattcaacatagtgttggaagttctggccagagcaattaggcaggagaaggaaataaagggtattcaactaggaaaagagaaagtcaaattgtccctgtttgcagatgacatgattgtatatctagaaaaccccattgtctcagctcaaaatctccttaagctgataagcaacttcagcaaagtctcaggatacaaaatcagtgtacaaaaatcacaagcattcttacacaccaacaacagacaaacagagagccaaatcatgagtgaactcccattcacaattgcttcaaagagaataaaatacctaggaatccaacttacaagggatgtgaaggacctcttcaaggagaagtacaaaccactgctcaatgaaataaaagaggatacaaacaaatggaagaacattccatgctcatgggtaggaagaatcaatatagtgaaaatggccatactgctgaaggtaatttacagattcaatgccatccccatcaagctaccaatgactttcttcacagaattggaaaaaactactttaaagttcatatggaaccagaaaagagcccgcatcgccaagtcgatcctaagctgaaagaacaaagctggaggtatcacgctacctgacttcaaactatactacaaggctacagtaaccaaaacagcatggtaatggtaccaaaacagagatatagatcaatggaacagaacagagccctcagaaataatgccgcatatctacaactatctgatctttgacaaacctgagaaaagcaagcaatggggaaaggattccctatttaataaatggtgctgggaaaactggctagccatatgtagaaagctgaaactggatcccttccttacaccttttacaaaaatgaattcaagatggattaaagatttaaacgttagacctaaaaccataaaaaccatagaagaaaacctaggcattaccattcaggacataggcatgggcaaggacttcatatctaaaacaccaaaagcaatggcaacaaaagacaaaattgacaaatgggatctaattaaactaaagagcttctgcacagcaaaagaaactaccatcagagtgaacaggcaacctacagaatgggagaaaattttcgcaacctactcatctgacaaagggctaatatccagaatctacaatgaactcaaacaaatttacaaaaaaaaacaaacaaccccatcaaaaagtgggcaaaggatatgaacagacacttctcaaaagaagacatatatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactacaaataccatttgacccagctatcccattactgggtatatacccaaaggactataaatcatgctgctataaagacacatgcacacgtatgtttattgtggcattatacacaatagcaaagacttggaaccaacccaaatgtccaacaatgatagagtggattaagaaaatgtggcacatatacaccatggaatactatgcagccataaaaaatgatgagttcatgtcctttgtagggacatggatgaaattggaaatcatcattctcagtaaactatcacaagaacaaaaagccaaacaccgcatattctcactcataggtgggaattgaatggtgagaacacatggacacagaaaagggaacatcacactctggggactgttgtggggtggggggaggggggagggatggcattgggagatatacctaatgctagatgacgagttagtgggtgcagcgcaccagcaaggcacatgtatacatatgtaactaacccgcacattgtgcacatgtaccctaaaacttaaagtataataataataaataaataaataaataaataaataaaaataacctaactgatctgagagaggtgaaaaacacactacaagaatttcacaatgcaattgcaagtattagcagcagaaaagagaaagttgagagaagaatctcagaacttgaagactagctttctgaaataagaaaattaggcaaaaataaagaaaaaggaatgaaaaggaatgaacaaaacctccaagaaatatgggattatgtaaagaggcaaaatctatgattcattggcaccctgaaaagaacagtaagaaagcaaataatttggaaaatatatttcaggatctcatccatgaaaacatccgcaactttgctagagaggccaacagtcaaattcaggaaatacagagaacccctgcaagatactacccaacaagatcatccccaaaacacataatcatcagattttctaaggtcaaaatgaaaaaaaaaattaaaggcagctagagagaaagagaagatttcttacaaagggaatatcatcaggctagaagcaaacctctcatcagatactctaaaagtcagaagagattaggggcttttattcaactttcttaaagaaaaaagatcttcaacaaagaatttcatatccagccaaactaagcttcatcagtgaaggagaaataagatccttttcagataagcaaatgctgaggcagttggttaccatcagaccaaccttacaagagatcttaaaaggagtaataaatatagaaagggaagaccattatctgccactacaaaaacacacttacatacacagaccagtgtttctataaggcagccacacaaagaagctggtataataactagataaaaatacaatgacaagatcaaattcacacatatcaatactaaccttgaatgtaaataggctaaatgccccattgaatagccatagagtggcaagctggataaaaaagcaagaatcaatggtatgctgtctttaagagattcatctcacactcaatgacacccataggctcaaaataaaaggaaggagaaaaatctaccaggcaaatagaaatgataaaaaatcaatggttgaaatcctaatttcagagaaacaatttaatttgacaaaggtcaaaaaagacaaaaaagggcgttgcataatggaaaagtttcaattcaacaagaagtcctaactattctaaatgtatgcacccaacacaggagcatccagattcataaagcaagttcttagagaccttcaaagagacttagactctcacacaataatagtgggaaacttcaacaccccagacagtattagacagaacatcaaggcagaaaattaatcaagatattcaggatctgaattcatcagtggaacaaatggatctgataagcttctatagaactctaccccaaaacaacagaatatacattgttcgtatcaccacatggaatatactctaaaattgaccttcaatcagacataaaacaatcctcagcaaatgcaaaagaactgaaatcataccaaacatattcttgaactacagcacaataaaaaataaataaagactaaacaaatcgctctaaaccacacgactacatggaaattatacaacttgctcctgaatgacttttgggtgaatcatgaaattaagggaggaatcaagaatttctttgaaactaatgagaaaaaaaatacaacataccagtatctctgggatatagctcaggcagtgttaatgagggaagtgtatagcacaaaacactcacatcaaaaagttagaaagatctcaaagtaacaacctaacatcataatgaaaggaactagagaaacaagagcaaatcaaccccaaagctatcagaaaacaagacataaccaaaatcagaactgaactgaaggaaatcgacacacaaagaaagcattcaaaagatcaatgaacccaggagttggacttttgaaaaaaatagtaagatagataagctgctagctagactaataaagaagaaaagagagaatatccaaataaacatgatcattaacaacagaaggtatattaccattgaccccaaagaagtacagataacccccagagagtattattaacgcctgtatgcacacaaactagaaaacctggaagagatggataaattcctggacacacaaaccttcccaagactgaaccaggaagaaattgattccctgaacagacaaaaagtgagctcctaagtaggattcagtaataaatagcctaccaaccaaaagaagccaggggccagatgaatttacagccaaattctaccagatgtacaaagaagagccgataacgttcctactgaaaacattccaaaaacttgagaaagaggactcctccccaacgcattctatgaggccagcatcatcctgatacaaaaactttgcagaagcaaaacaacaacaacaacaacaaacttcaggcagatatccttgatgaacattcatgcaaaaatcctcaaacacacacacacacacacacacacacacacacacacacacacaaactcacaaactgaatccagccgagtagcacatcaaaaatcttatttacctatcccagcactttgggaggccaaggcaggcagatcaggaggccaggagtttgagaccagcctggccaacacagtgaaaccccgtctctactaaaaatacaaaaattaactgggcgtggtggtgggtgcctgtaatcccagctactcggaaggctgaggcaggagaatcgcttgaacttgggaggcagaggttgcagtgagcccagatcatgccactgagcctgggtgaaagagttagactccatctcaaaaaaaaaaaaagcttatttccacgatcaagtaggctttattcctggatgcaaggctggttgaacatatgcaaatcaatgaacccgattcatcacataaacagaactgaagacaaaaacatgatcatctcaatagatgcagaaaaggtttttgataaaattcaacatttcttcatgtaaaaaattctcaacaaactagatattgaaggaacatacctcaaaatgataagagccatctatgacaaatccacagccaaattcatactgaaagggcaacagccttcttttgagaagtgtctgttcatatcctttgcccactttttgatggggttgtttggttttttcttttttttttattattatactttaagttttagggtacatgtgcacaacgtgcaggtttgttacatatgtatacatgtgccatgttggtgtgctgcacccattaattcgtcatttaacattaggtatatctcctaatgctatcccttccccctccccctaccccgcaacaggcgccagagtgtgatgttccccttcctgtgatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatttagaactagaaataccatttgacccagctatcccgttactgggtatacacccaaaggattataaatcatgctgctataaagacacatgcacacgtatgtttatagcggcactattcacaatagcaaagacttggaaccaacccaaatgtccaacaatgatagactggatgaagaaaatgtggcacatatacaccatggaatactatgcagccataaaaaaggatgagttcatgtcctttgtagggacatggatgaaactggaaaccatcattctcagcaaactatcacaaggacaaaaaaccaaacacggcatgttcccactcataggtgggaattgaacaatgagaacacatggttgtttttttcttgtaaatttgttggagttcactgtagattctggatattaaccctttgtcagaagagtagattgcaaaaattttctcccattctgtaggttgcctgttcactctgatggtagtttcttttgctgtgcagaggctctttagtttaattagatcccatttgtcaattttggcttgtgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagagaattgtttccccatttcttgtttttgtcaggtttgtcaaagatcagatggttgtagatatgcagcattatttctgagggctctgttttggaaccaagccaaatatccaacaatgatagactggattaagaaaatgtggcacatatacaccatggaatactatgcagccatgaaaaatgatgagttcttgtcctttgtagggacagggatgaagctgaaaaccatcattctcagcaaactatggcaaggacaaaaaaccaaacaccgcatgttctcactcacaggtgggaattgaacaatgagaacacgtggacacaggaaggggaacatcacacaccggggcctgttggggggtggggggaggggggagggatagcattaggagatatgcctaatgttaaatgaccagttaatgggtgcagcacaccaacatggcacatgtatacatatgtaactaacctgcacgttgtgcacatgtaccctaaaacttaaagtataataaaaaaaggacagttaaataagctgaaaataaatcagagaaaattataatgagatgaaattagaatgtgaatgataaagaaatgaagtacaaaattagaaggtctgcatttatctaataatatttctaaaaggtgaaactggagtaaacgtattcattatttgaagaaatagttggtaagcattttatcataggtgacattagaattaaatattcagaattaagcaggacatggaatctccagtaaaataaatgaaaacaaatatatgactatacaactgtatcagaaccctcccatcagcctcattcttctcttgttccagtgtttactgggctctggcagccttctcatatagaccacttgagaatgtctaacttactgttcatagcttccccaaatctaccttctcctttactctcttctcactccagcaggtgctcttgctgccaaagcaaccctcacagtgttcccacaggctgagccagtggaaggattcttgctcctttctccacactgcctccccatggttttgagatgcattttctaggacttctaggagttttgatcaagatccagcttgatcatacattctcacattggatcaccctccttccctgccttagcactcttgccctgcaatcctggtcactttgattatattccccaataaagtaatagcacttaaatttttgtctcaggctctgctttctggggaaccaaggctaaaaaacagctgatgaaccacagtacattaatagcaaagagaaaagtctaaaaagcaatttggaagaaatacaataccaaataggaagagcaattagactggtagtaattgtcccattattaccaatagaagcaagaatataattgaaaaatattatcctcaaagtgccaaaagaaattaccactatatataaaatacaatactcaacaaccatattagaaaatgaaagaaaagacactttcagacaaaggcagctatttttacctagactctcatgggtagaacttctaaggaataggtttctatagaaaagaattaagtttacaggagacagtgggattaaagaaacaatggtagacaaagaaatggatatacgtgtacataaatccaagatggattaaatgttaaacatcacataattgagtgactaagttggaggcagatttaaaaatacagtgcaattaagttccagacaataactacatggaagataaaataaactatgatcagaatgcttttaatttctcattttttctggatattgtacagatattaaacgtaagactgtgataattcaagtatgaatgtcagcactctaaccactaaatatctggcatttagaataggtaaccttcatatttgttgagggaaaaattgttgaatgagaaattcaagttacaaaaaacatactattcacgcaaagtcaaaacacacataaccagaataaatatcgtttgtaactgcaaaaaaagtcttcgtgtaaaaaatatggatggtagaatatagtcaaatcttaagcagtgtataactctgagcaggaagggaaatgctatgaatgttaagggctgtcaaacgtataactaatattttatttctaaaacaaaagttatcaatcaaatatagaaaaatcacatcttaaatcagggttttggatagactggtggttttctgttgtttttttttgtacgttcgagacagtttgtaataagcaagtgttaaaaattgataatagatttgtgttatttattaactcattaactcttatatcatgctttctcttctcctcctttgacaagtctttcttctctcctctttctccttatttatcactagtacaaaatcttgtacatggcacacagtaagcacacattaaatatttgttgatatgaataatgtatgtgaatgtactttgcaaagtaaaaccattatcataagtataatctcctcacaaaaatagcataatttcctccaagaagtgaactgctgtaagctgtgtaatattctatggagtatctcaaaattaaaagatgtaaaaattatgtgtactatattcccaaacgtatactaaataatattaaagttgaaaaaatttgactaacatcagtatattagctaaaacttttaaaaataaatgtcctaccaaattgctagattccagaaagctgcagactagagcactttcttaaatgtgattctgataaaattcctgtagacctacttttgcaaacaaacatttctgtagtgaaactgttactatatatcactggataaaccacagcatatacgaataaactaactatttattgctacacaattatatataacttatgtggaagactattaagtatcctagtatacaaaggcaatctattaatctaagagtataatttataaaagaggtgagaatagataccttattgttatgccagaataaatgctatcagaattgcacttgaggtactattataaagtaggacacttgctggaagagaaaacaaattatcaagtgtgggaggcaaaagaaagaataatgaaaattttaacctctttccacagaattgtgggcaatatatgctttagcaaaggaactaaaatgacaaaaaatcgtttttttaaaaaatattttatttctggttactaggttctgccagagcacttctaaccaaatatatacatgtgtgtatatagatgtatatgtatataaatcatggccaaatcatatgtatatgtatgtatatatacatatatacatacatatatatacatatacatatgatttggtcatgatttttaaagtaatgtgtttttttcaaaaattgcagtatttcacagaatataaacacataatattttgcccaatgttatctgagatttaataaaaactatcattatctaatgtcctcataatgagattctatactatgcaagaacaaaacagaattgaaagaatatattaatatccacatgttatagttagtacaaccagggtggcacattcataagagatgatctcaagacccacaaatatacctgcattcacagacctcaatctactctagcattagtttcaccaccccatttaaaaatattgtgaacctttctcaaaagtctactctaagtcaaactctctttcacagtcaactaagatatcacatacttatttcatggacaccaagggagaattgaactctggtatcaaaatatgctttgagtccactgagagactcttttagagccatagtctatatacataataaaaactgtgagttgataatcacaacataaaactcatttggtgtttaagcctacagtgtttccttgaaattgatgttctatggatctttattatattaatattactggaaaagagataaaaattttaaactatattatgcttcataaaaacacgtacagttggcaaagtgtataaacaagtcaaatcttttcatttgtattttatgttttacatttttagaaaagtttcaaactcaaataaaagttgatggacaagtgaaataaatgaacatcccaattattgttatgtcccaattgttatagtgcaatatcaccacaacaattccatctttctctacacacacacacgcacaaacacacacacatgcacatgcctctcttttatcaaacaatctgaaattaggttgaggacgtcatatttcaccctgtctacttcattattcctctcccttgtattaaggatcctttatacatgtccattaccacactttaaaaaattaacattagatcaatactattattcactatactaaaactttcctcatttgcactctgatcaaaatgcacatttgtacatagcttttttcttttcccccatgatccaattgatttattcaaccatattttttttgctataatggctctttaggttcctgtgatctgcaggtgttaatctgctgtcctctacttttaatggcaccaagtcctttgcagagtcaaggccagttgttcttcagtatattccaccttcaggattcatctgaatgtttccctatgtttagattgagatcaaatatttatgacaaagacatcacatagatgatgttatgaaactttcactacatctcatcaataggcatataatatgagaatataacactattagtgatttacgaggtgactaccagtctttccattgtaaagtcatagtttccatctataaatagtaattaattaaagggatggtgaatatattgttctccatactttcttaccatatagttttagccattgatcctcatatgaatctattttgacatcaagggttacaaaataccaagtttctaattctgaaatttctttaatatttatttgctgagatcatttggtaaggaagaatatctcctattttttctatttctctcacttcttcttaaatgcattatgaatatttctttgcttattcatggaaatttttaattagttcatttaatatcattcttgtctttaatggtcacatagtacaaaatttatccattaaattcaccctcaaactagctcccggatcctttgaatgtggttccatttgtgtttgagcacttccttacattctggttcaccttgtacttcctctgttctttcctataatcagtcatctctccaaggaaccttcattcctttcctttcagcaagaatttatttttagaaatcaagatctcagtgttatttatactctttggtactggcacgtcaacatgttaaagccttacaattatttctaactctttttcaccctaattattttctagagttagaatataattgttatattgagatgcagtgttttttttttttaaaaaaaaacaacaatcgacacaattaagggagggtgatatattttgattctgcattattcctttgtttctctaggagctctaatctcctccacttgctttattctttctcttaattttcaaagtccaaggaatgcccatccctttccaagttgctccctttcctccagaatcactgtcttcctatgactgttacctctgatcctatattttcaggtcccttcctttgaattctcagtagccaatattctgatccttcttatcctatacctcttatacctgttcttagtattttccctctcagggtaggacctcattttttttttttttttttaccatttcagagagagaattgtaggttttattgactaagaaggtaaagggatgcaaattacttatacaggttttaattccagacaacagaatagtggctattagcaataaaatcagtgagtattctgaacatgttcaatttccaggtaggggattttattggaaatatggatctagagctagtagaagaagctatatttaggagtcatccacaaagaagcttgagaaacaaatgaaagtgtatattgagaagtgcgtagagaacaatgttaagggggctgtggggaaaaaacaacatttagaagataactgaaggaaatcatagaggacaaaaagtacaatctaatttttctccctgactgagtgaaaaaccacttttaatactattgtaataagaatttattatgacctcttcatgatactgccattttttttcaatctcaacaatcatcatcacatcccagagctatctcatgacaagagctttctaaatactaattgcctgaacactgaagaaaattagtatctgatactaaggtgtaacttctctgtaattcaaaaaagggaggccttctgttcttgaaatattcaaactaaacaggacaattttacctgaagctgttctcacaaccctatttttcagcattataagtttgctaatggacaaacatgctcataactgaaatatttaaattatgtaaaagtataactctacaacctgcagaactaacatttgatgcatttttcctggtctttcaatgctaagtttttattgcgtgtatgtaaatatcatttattgaaggcttactaaataccaaaccctgtgttaaaacactgtcttaggacctcctttttctaagggaaatttatctgtgttttggcactactactatactgctgcatgttcctgattttcaagcagtctcatctggatctcttcagcctgggctccagagcagaatctgctggtttcatgtttttcttctccctagcatatataaactcaagttgtactgctctttgacctttaattatgctgttggcataagatttatatggttttatttgctttccttgttgacctctggagcatgtgtagaaatattaggatttaagaagctgctgttgttctacaggaattcagaggtctgaaacaaccactttatgtttgaaattatttttatgttttatttaaatttttaacttgcattgcatgtggagttattgttcactcaaaaaagaggaagggctttaaaaacacaaacaatataattgcaagattcacaataatattatttttaattagagaagggcttatgtctctgaaccaagttacttttatttttgaggttcacttacactgctctgaaaattctaaaatcaaaaacaaatttaagaatggaagagtattttttcataatttcttctgtctagcacttctgaattaactaagaaatcacttatgtgcctactgaataatgatgtgttagacatcaaaaattaattttaatcagtttctcatttatttttccgtttcgtatagtgttcagatggttagactgtttttagatgcctgccttctttttaactaagaaatagtaaatcaagtgagagtacaaaaagaaaacaaatgacactgggaaagattatagcatctaattgaacagaagaaaacctaggaacttatcaaagtcatttaaaatttccaatcagccattaccaatatcttcttaaagtttaataagtgtgttttccattttgccagccaggtcattaatgatcaattctctcactccccacactggtttacaagctacaatgatattgcagtgtttgttagtaggactacaaaaagtagaatcaagataatgtcaatcctgctatacaccacagccattatacgctgctttgggcaagagagagtggggtggggaagggtgagcactggggaaaggggattaccttaagtagataagtatacagcaaacaataagtagttaaaataaatacaagtttttatctacttgaatttctggtcccatatcccaatgcagtaaatgctggtaatctgaaacagaccacataggatgctctaccttttctaaagtagttaggcttaaatagctttatgtcaaagcaggccatactctgttttaattcttctgtaatttattcaacaaaaatgtgagtttaaaatgtgatcggttctatactataagctaaaatattctttgtttatacttttccaaagcttacagtctattggaaaggaagcaatgaaacaataataccaaatacatgcaattaaaaatattgacaagttttcatgtgaaaaatgtgctattttgagacacacaaatataacagcagtcatgatttagatgagggattggagtagatctccttaaaggtatcctgagaataggagttagcctaagggagaacaggtaagcaggaatggggatgacatggcaggcgttcacacttcagcttccttactttctaatttggagctgtgtgaaaacaagagacagaagaaaaacgagcaataacaaaatggcctgtatttaacagagtagctcattggtttgaccaatgctctagccattttggtgaaatggatagaaccactttgatgaactaaaattttaacacagcatccacttcccaaagtaagtaaggcttattcattctaaagaatgcctagactatcctcctctttttggaggtgttatgtgagggattagaaaatggtcagagagtagctttgaattacttctcgtggaagcaacatgcctgattttgagcagatggtctctcagaaagaaacatctagaagcatccttcacatttctggtccttccttaattgtctgcagtcacatctccttctccttcttgtcccactgaagacagtattctttttttatttattttatttttttattatactttaagttttagggtacatatgcacaatgtgcaggttagttacatatgtatatatgtgccatgttggtgtgctgcacccattaactcgtcatttaacattaggtatatctcctaatgctatccctccccccatcccccaccccacaacaggccccagtgtgtgagttccccttcctgtgaccatgtgttctcattgttcaattcccacctatgagtgagaacatgccgtgtttggttttttgttcttgcaatagtttgctgagaatgatggtttccagcttcatccatgtccctcgaaaggacaagaactcatcattgtttatggctgcatagtattccatggtgtatatgtgccacattttcttcatccagtctatcattgttggacatttgggttggttccaagtctttgctattgtgaatagtgctgcaataaacatacgtgtgcatgtgtctttatagcagcatgatttataatactttgggtatattcccagtaatgggatggctggatcaaatggtatttctagttcaagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtgagatggtatgttttagactgataatccttccacctgtcttctagatttcatatattatcatttcttcaaggacatggcttcatcagactcatgttccattatcttctccccctctactggttctttcaccttcaacaattaagaaaatattcatttaaactaccaaaatcttcaaaaacaactcttctttaattctgcatcttccccaccctgctaccaccatcaacagcaatctcaccactcctttcatgcactttattcctcagtttctttggaaagtaatataagctctgtacctctacttcttaatccctatgcatttctcaacttactggaatttaaattattctctagtcactccactaataaaagcaatcactgctatcaacaaggtcatctaatttttcaaatccagttgtaacttttctgggatcattttacatgacctctgaaatccccagaattgttggtcacctccatttccctgaaattcctttctcctttgatttctatgacccctctaaagatgttccttgcttatctttcccctctgcaagatcttcttttggtgctttccagagcttacttaaagcttttcaaatacatgtatatttggaaaataaatgttgttcagtaagtgcttccaatcttttctcttctgtctttcaacaaaagaggttctgactgctctttattagtctttctgttgccatcagctctctgaaaggagacagactttcacaacatattttttttttattctagtccacattgaattagggaaagaggaagaagtaaacaaataagagaaatatattcttgcttaagaaatagttattggcagagtgtctagagaggataacagagaagattagggttcaattaaaaagtttggaaaagctaagctaaaaataattgtttggtgaaaagaaagtgcatgggaaaatggcattttaaacgagtttctctaaatgaaatgtatctttgccagagtttgataaacacatgtaaaaactccaattattttgaagttcatttggttcacgggctgtgtttcttgttctaaaacacaactctcagactagaatatgggtttcatttattcaattgtgttatccacagattagaacataggatgcctcattttgtgaaaattcactgagctgtgtgcttttatgattggtacacttctctgtaagctatactttaataaaggatttatttgtaaatatttttttctcatggtgattcatggcagcccttcctaaatttatatcctactcagactcagcttttgagctcaagacataaattttcaactacttagcagataatcccaatcccgtgaaccatagacaactatatacaacatgttcaagtggaaaacttgtttttactcatctattttctacttctgtaagcaggaccacaatatagctagttgttcggaatagatatttcttttccatataatccaggttctgaggcaggcccagattatccccattccttgttccacatacacacatctatcatcttagttagtccatgccacatttataagccaaaagagtatacacatctggtctttttaagggcagttatatatcccactatccattcttgtcaatccttccacaaaaatcctattttttctttttaatctaaacatatttctatccattcagtttcttcagcagaacataagagcatccaaaactcatttggttttgccaaatgatggaggttgttgtgaaaactttgcagctcttaactgatttaatccttaacaaaatttataaagaaaatattataattattatctcagttcgatagatataaatctgaagcatcaaaacatttcataatagctaacaatgggtagaacttggatttgaaccaaggtagtatgacttcagaatctctgctgttaagcagctttcaagacccagtacaagttgttctttccaaccttccttttattgacttcttttgtatttcctaaaaatatcatgttttctatctctgagagcttttagattattttcctctcacctcaaaaactctcctcatagtcatggccatacaaatcttgtctacctaaataactcctctttcacaaagtaacacatattatcttcttccaaactttctcctgacatctccatctttatcttatgagatgacagggatacctttaccactacttttttttaacctgccattataattgttttccctcttatttgttgcccttattaagaaaaattcatgaagctaatcactgtttaatgatagtaatctatgcattatgtggtatacagttaacgatataaagttattgtctactaaattgataaagttacagagcaataatatttctgtgactaattaatggtgaaataataactcagataatccaaaccaaccaggggctgaagggatcccccagcacagattgctctaccaaaacgcggccagactccttctttaagcacgtccctgcactcttcctcctcactgagtgggacttccctacaggggcctccagtggctagatgttcccactagtggctagatgaatccactgatgatccctggttgacagagatttgaattctccctgggatggagttctcagagggaggagcagactaatatctttgctgtttgagcaactcagatgttctgcaggctttggagagcccaagatgaccagggcagaagtaggaccccagcacagcacagctgctctacaaaagcgtggccagactgcttctttaagtgggtccccaattctgttcctcctcactgggcggaacctcctatctggggcctccagccaacacactggtgttctgtggctgaaagattaaaattctccctgggatggagttcccagggggaggggcgggcccccatctttgttgtttgggctttgaaaagctcaggctgacctggggagggagcagcatggaaacacggcacagctgctctgtgaaagtgtggccagaccgcttctttaagcaagtccctgatttattcctcctcactgtgcaggacctcccaaccagggcctcgagccaactccaccacacacaggctcaaaataaagggatggagaaaaatctaccaagtaaatggaaaacagaaaatagcagagattgaaattctagtttctgaaagaaacagactttgaaccaacaaagatcaagaaagacaaagaagagccttacataatggtaaagggttaaattcaacaagaagagctaactatcctaagtatatctatattcatctgtctgtcgatcgattgatagagatgcacttagcataggagcacccagattcataaagcaagttcttagagaccttcaaagagacttagactcccacacaataataatgggagacattaaaaactcactgacaatataagacagatcatcacgatagaaaattaacaaagatgttaaggaactgagctcagcactgggtcaaatggacatgatagatatctacagagctctccacccaaaaacaacagaatatacattcttctaattgccacattgcacctactctgaagtcgatcacgcaatcggaggtaaaacactgctcagcaaatggaaaagaaccgaaatcataacaaacagtctctcagaccacttttttgaatctaattcaaaatcaggactaagaaattcactcaaaaccaaacaattacatgaaaattaaataacctgttcctaaatgacttttgggtaaataatgaaattaagacagccatcaagaagttcttgaaactaatgagaacaaagatacaacacaccagaatctctgggacccagctgaggcagcgttaagataaaaatttatggcacgatatgcaaacatcaagagttagaaagatctcaagttaacaatctaacatcacaactaaaagaacttgagaaccaagagcaaacaaattccaaagctagcagaagacaagaaataaacaaaatcagagatgaagtgaaggagatggagacatgaaaaactattcaaaagatcaacgaatccaggagctgttttttgaaaaaattaataaaatagatcactaactagactaataaagaagaaaaggaagaagattcaaataaacacaataagaaataataaggggaatattaccactgatcccacagaaataaaatcatcacagaatattataaacacctctatgcacataaactagaaaatctagaataaattggtaaattcctggacacatacaccctcccaagactgaacctcctatggaaagtatttcaaaaaattaaaaaggagggattcctccctaatttattctatgaggccagcatcatcctgataccaaaacctgggagagatacaagaaaagaaaacttcaggccaatatacttgatgagcactgatgaaaaaatcttcagcaaaatactggcaaattgaatccaacagcacatcaaaaagcatatccaccatgatcaggtagacttcatcactgagatgcaaggttagttcaacatacccaaatcaatatatatgattcatcacataaagagaactaaagacaaaaacatatgatatctcaatggaggcagaaaaggcctttgataaatttcaacatccattcatgttcaaaactctcaataaactaggtaatgaaggaacataactcaaaataataagagccatattcgacaaacccacagccaacagcatactgaacaggcaaaaactggaagcatgtcccttgaaaactggaacaagacaaggatgccctctctcaccactcatattcaacatagtattgggagttgtggccagggcaatcaggcaagagaaagaaagaaaagacattcaaataggaagagaggaagtcagatatccctgtttgcagatgacatgatcctatatctagaaaacccaaccgtctcagcccaaaagtttcctaaactgataagcaacctcaacgaagcctcagcatacaaaatcaatgggcaaacatcactagcattcctatacaccaacaacagtcaagctgtgagccaaatcaggaatgtacaagttctgtacaagatcccattcccaattgccacaaaaaagaataaaatacttaggaatacagctaactaggggagtaaatatctctacaagaagaactgctgagcattgctcaaagaatggaacacaaatggaaaaacatttgatgctcatagatagaaagacccaaccaatattgttaaaatggccatactgcccaaagcaattcatagcttcaattctattcccattaaactaccattgacattcttcacagaactagaaaaaactattttaaaattcatatggaaccaaagaaagagcccgaagagcaaggcagcccaaagcaaaaagaaagaagctggaggcatcatgctacctgacttcaaactgtattacaaggctacagtaaccaaaacaggattgcacaggcacaagaacagaaacataggccaatggaacagaatagagaacccagaaataaaactgcacacctacaaccatctgatcttggacaaacctgacaaaaacaagcaatgaggaaatgattcccttttcaataaatggtgctgggaagactggtacccatatgcagaagactgaaattgaatcccatcctgatttaattctcagcttggtcgctggttggtgtatagcagtgctactgatttgtgtgcattgattttgtatcctaaaacttcactgaattcatttatcagatctaggagtttttggattagtctttaggattttctaggtatacaatcatatcattggttaacatcgacagtttgacttcctctttaccaatttggatttcctttatttctttctcttgcctgattgctctggctagaacttccagtactatgttgaatagaagtggtgatagtgggcatccttgtcctcttccagttctcagggagaatattttcaacttttccccattcagtacaatgttggctgtgggtttgtcatagatggcttttattaccttaaggtatatcccttctatgtcactttgctgaaggttttaatcataaagcgatgctggattgtgtcaaatggtttttctgcatctattgagataatcacatgatttttgtttttaattctgtttatgtggtgtatcacatttattggcttgcaaatgttaaaccatcactgaatctctggtataaaacccacagctgcaaaacaaaataaagtaaaataaaatacttaggaatatacctaagaagggaggtgaaagatctctacaagtgtattagtccgctttcacactgctgatgaagacataccagagactgggaagaaaaataggtttacccctaccatgagaacagtatgggggaaactgcccccgtgattcaaatgatctcccaccaggtccctcccacaacatgtgggaattatgggagtacaattcaagatgagatttgggtggggacacagagccaaaccatatcattctgcctctggcccctccaaatctcatgtccttacatttcaaaaccaatcataccttcccaacagtcccccaaagtcaactcatttcagcattaactcaaaagtccacagtccaaagtcttatctgagacaaggcaagtcccttccacctatgagcctgtaaaatcaaaagcaagttagttacttcttagatacaatgggggtacagacattgggtaaatacagccattccaaatgggggaaattggccaaaacaaaggggctaccagcctcatgcaagtctgagatccagcggggcagtcaaatcttaaagccccaaaatgatctctgatgccatgtctcgcatctgggtcatgctgatgcaagagataggctcccacagccttgtgaagctcccttgtagctttgcagggtatagcccccctcctggctgcttttatgggttggcgttgagtgtctgtggcttttccaggcacatggtgaaagctgtcagtggatctaccattctggggtgtgggggacagtgaccctcttctcacagctccactaggtggtggccagtagggactctttgtgggggctctgaccacacatttcccatctgcactgccctagcagaggttctccatgaggaccccgccactgcagcaaacttctgcctgggcatccagatgtttccatacatcttctgaaatctaggcggaggttcccaaacctcaattgttgacttctgtgcactcgcaagctcaacaccacatggaagctgccaaggtttgggacttgcaccctctgaagccatggcctgagctctatgtcagcccctttaagccatggctggagcagctgggaccgagggtaccaagtccctagactgcacacagcacagggaagctggacctggcccatgaaaccattttctcctaggcctcctggcttgtgatgggagggggcttccatgaagacctctgacatgcccattgtctgggggattaatatttggctcctcattacttatgcaaatttctgcagccagcttgaatttctcctcaaaaaatggcgttttcttttctattgcattctcaggctgcaaattttccaaacttttatgctgtgtttccctttgaaaactgaatgcttttaacagcacccaagtcacatcttgaatgctttgctgcctagaaatttcttccaccagataccctaaatcatctctctcaagttcaaagttctacaaatctctagggccggggcaaaatgctgccaatctctttgctaaagcataacaagagtcgcctttgttccagttcccaacaagttcctcatctccatctgagaccacttcaggctggaccttattgttcacatcagtatcagcatttttgtcaaagccattcaacaagtttctagcaagttccaaactttcccacattttcctgtcttcttctaagccctccaaactgtttcaacctctgcctattacccagttccaaagtctcttccacattttggggtatcttttcagcaacaccccactctactggtaccaatttactgtattagtctgttttcatgctgctgacaaagacataccagagagtgagaagaaaaagaggtttaattggatttacaacaccacatggctggggaggcctcagaatcatggtcggaggcaaaaggcaattcttacatggtggcggcaagagaaaatgaggaagatgcaaaagcagaaacccctgataaaaccgtcagatctcatgagacttattcagtaccactagaatagtatgggggaaactgcccccatgattcaaagtatctgccactgggtccctcctacaacacgtgggaattatgggagtataattcaagatgagatttggatggggacacaaagcaaaaccatatcaaaaaggaaaactacaaaacactgctgaaagaaatcatagacaacacaatcaaatggaaataaatcacatgcttgttgatgggttgaatcaatattgtgaaaatgatcatactgccaaaagcaatctataaattcaatgcaattcccaccaaataccatcattattcttcacagaactagagaaaacattcctaaaatttatatggaaccagaaaagagcccacatagccaaagaaagactaagcaaaacaaacaagtctggaggaatcacactacctgatttcaagctatactgtaagaccatagtcaccaaaacatcatggtactggtataaaaatagacacatagaccaatggaacagaaaagacaacccaaaaaataaagccagatacttacagccaactgttcttcaacaaagcaaacaaaaacataaagtggggaaaggacaaatggtgctggaataattggctagccacatgtaggagaatgaaactggatgctcatctctcaccttatacaaaaattaactcaagatggattaaggacttaaatctaagacctgaaactatacaaattctagagcataacattggaaaaccccttctaaacactggcttaaggcaagaatttcatgaccaagaacccaaaagcaaatgcaataaaaacaaacataaatagctgggacctaattaaactaaagagctttttcatggcaaaaggaacagtcagcagagtaaacagacaacccacagagtgggagaaagtctttaaaatctatacatctcacaaaggactaatatccagcatcaataaactcaaacaaatcagcaagaaaaaaagcaaataataccattcaaaaagtgtgctaaggatatgaataaacaattatcaaaagaagatacataaatgaccaacaaacatacgaaaaaaatgctcaaaatcactaatgatcagggaaatgcaaaatcaaaaacacaatgcaatatcaccttactcttgtcagaatgtccgtaatcaaaaaatcaaaaaacagtagatgttggcatggatgtggtgatcagggaacacttctacactgctggtgagaatgtaaactagtataaccactatggaaagcagtgtggagattccttaaagaactaaaaatagaactaccatttgatccagcaatcccattactgggtatctacccagagaaaaaaaagtcattatacgaaaaagatacttgcacacgcaggtctatagcagcacaatttgcaattgcaaaatcatggaaccaatccaattgcccatcaatcaatgagtggataaagcctgtgtgtgtgtgtatatatatatatattctatatatatctcatatatctatcataattatcatatatatcacatatacatatctcatatatatctcatatatgtgatatatatcatatattaatatgccatatatatcatatattgtatgtgtaacatatatatgatatgatacatatataatggaatactgctcagccataaaaaggaatcaattaaaggcatttgcagtgacctggatgaaattggagactatcattctaaaggaagtaattcaggaatggaaaaaccaaacatcatatgttctcactgatatatgggagctaagctatgaggacacaaaggcataagaataataaaatggactttggggatttagaggaaagggtgggaggggggcgagggatagaagactacaaataggatgcagtgtatactgctcgggtgatggctgcaccaaaatctcacatatcactgctaaagaacttactcatgtaaccaaacaccacctgtaccccaataacctatggaaagataaaaaataaattttttaaaaaattttaaagatggattaaatgcttaaatgtaaaacccaaaactataaaaaccccagaaggcaataccattcaggacatagacacaagcaaagatttcatgacaaagatgccaaaagcaatggcaacaaaagcaaaaactgacaaatgggatctaattaaactaaagagctcctgcacagcaaaagaaactgtcaacagagtaaacagacagcctacagaatgggagaaaaatttttgcaaactatgtaactgacaaaggtctgatagccagcatctataaggaacttaaacaaatttataagaaaaaaccaaccctatgaaaaagtgggcaaagggcatgtacagacacttttcataagaagacataccagtggccaacaatcgtgaaaaaaagctcaacatcacagatcattagtgaaattataatcaaaaccacagtgagataccatctaacactagtcagaacagctactatgaaaaagtcaaaaaataacacatgttggcaaggtcgtggagaaaaaggaacatatatacactgttgatgggagtgtaaattagttcagccattgtggaagacagtgtggcaattcctcaaatacctaaagacagaagtaccatttgacccagcaatcccatcactgggtatctacccaaaggaatataaaaggttctattgtaaagacacagtatattgattgcagcactatttacaataacaaagacaaggaatcgacttaaatatccaccagtgatagactgtatagtgaaaatgtggtacatatacaccatggaatactatgcaaccataaaaaagaatgaaatcatgtcctttgcactgacatggatggagctggaggccattagccttagcaaactaacataggaacagaaaatgaaatactgtgtgttctcacttataagtgggagctaattgatgagaacacatgggcacataaaggagacaacacacactgtgacattttggagggtggagggtagtaggaggaagaggatcatgaaatacaactaatggatactaggcttaatatgtgggtgatgaaataatctgcacaaaaaacttccatgactcaagtttacctatgtaacaaacttgcacttgtacccctgaatttaaaatagaagttaacaataactcctcttttgttttttttgatatttaatttttgtggatacatagtaagtttatatatttgggagtatacaggatattttcatacaggcatacaatgtgtactgatcacatcagggtaaatgaggtatccatcacctcaagaatttatcctttatgttacaaacaaacaatccaattatactattttagttattttaaaatgtacaattaaattattattgactacagtcaccctgttttgttataaaatactagatcttgttcattctttctaactattttttgtactcattaaacattctcacatccccatcaacttccactacccttcccagcctctggtaaccatctttctctctacctccatgaattcaattgttttaacatttagatcccacaaatgagtgagaacatgtgaagtttgtctttttgtgcttgccttatttcacttaacataatgatctccagttgcatccatgttgttgcaaatgacagaatctcattctttttgtggctggatagtactccattctgtatatgtgccacattttctttattcattcatctgttgatgaatgcttaaattgcttccaaatcttggctattgttaataagtgctccaataaatatgggagtgcagatatctcctcaataaactgatttccctttttttggcttttagctatatacctagcagtgggattgacggattgtatggtagctttatttttagtcttttgaggaacctccaaattgttctccatagtagttgtactaacttaccttcccaccaacatcgtagaagggttctcttttctccacatcctctccagaatttgttattgcctgtcttttggatataagccattttaactggggtgagatgatatgtcattgtagctttgatttgcatttctctaatgataagtgatgttgagcaccttttagtgtacctctttgccatttgtgtgtcttcttttgagaaatatctattcaaatcttttgcttatttttagtcactttattagatttattcttatagagtgaacattttaaatatccttgttattaatcccttgtcagatgcatactttgcaaatgttttatcccactctgtgggttgtctcttgactttgctgattgtttcctttgctgcacagaagattttcaacttgatgtgatcccacttgttcatgtttgctttggttgctgtggttgtggtgttttgctcaagatatctttgcccagacaaatgtcctggaaattttctctaatgttttcttgtagcagtttcatagtttgaggttgtaggtttaagtttttaattaatttggatttgatttttgtatagggaaaaagataggggtcaagtttccttcttctgcatgttcatattcaattttcccagcttcatttattgaaaagactgcactttctccagtgtatgttcctggcactttttgtcaaaaatgagttcactgtacatgtatggatttgtttctgggttctctcttctgttccattggtctatgtgtttgtttattaacttatgtttgattataattttatctcaattgaatgaatgaatatttgaaccagtgtgaaatttgtcctttcaaaaatgtcagcttcaggaagaatacaagtgcagcagtaaatacaattttttaaaaagcaccatctaatcaggcaaaccagtcaagtaatctaggatattagggggtggcagagcacaaaaccacatttcactgatattagatgctatcagttcaaagggagacatctccaccggtgtttcatcatttctagttctcttgtaacaaatacgtaagtacatacaaacataaaaatgcaaaaataaacatcataacttctctagtactgtgccagtggtgctaaacacattttactagaaattcttttagaaaataaactattttttatggattatatatgtagtatgtgttattaacaatttcatctaatttgatttatagaaatacatttaaatcattttaaagctcaatttaaaataactaagaaaaagtatcagttttagaaatgcagtactggtaatgtatcagtaggtgtgaagtttttgttgtttaagacattaacatcaaaataaatgtatgattccataaagaagtactctatgattttgatgaatttgttcaaacactaattcaggttgacatggagaaattactttagaaaaatattagaaatatcctataggttttacctattttcttttctcttatctgtgtgtgtggtgtttgtgtgtttatatttcctgtcataatgctttgtaaatatatcctaatagagagaaaaatctaaccaaaccaaacaatatgaaacaacagtttttataaattcatcggaaaacatcatgtagatttgagttgaacaagcctaaccacagaaacaaaatacacagatcatagaacaattctatatatattgctgaaaaatgatactcaaattgtccattatcttttgtattgaaaaaaaagaatcctatgctatcacatgacaaatctaagagctgtttaccatcaggtccaaatctcatctgtttttaatttcacattttcaagtagatctggcaaattctcttgatagctatgaatgctcataacatttcttaaaccatatttcatactcttaaattatcaaagtaatgcaaatcagtgtttaatgccactaattccttgaacttttttttcatgataggtattaaccttaacctaaataaaagtaaataggatctattaaagctcctaagaggaaaataattttcttctcagctcagtgaattcattgcaaacagaagcaatattgtggcctaatatgagtagtgaacagtttgtacactgttgactcatctacaaatctccatttacttagtagtaaatcaatgtaatctagactgcaacccatggtgttgctgtagtcgtagtgaagactatacatccaactttgttagtgttgtttgatcctctaattagaatatgaaatatagagttttagtgacccagtagaaaaattaatggagagaaaatttaaatacgctatgatcaattttgaatgctttatgttttaggattctatacaggatacaaaagctgcataatactttgagacagaatacttattcagttggattcaataaaaattttagatcctattatatgccagagtctgtgctaagtattgtaaaaacataccaataaaaaagtaagaaatcttgcctacaatgagctcatggaatggtatatgagaaaatatatacccaatgaccttaatgcagtttaatgggataagggccatggaagaatttcaagttgcaatagataggcagatgatggaaatacttgctttgtctcctaatgctgcaaaatggttcatctaggggaaagtggcattttaggagtccttcaatgaatgacatctctttcaaagatggaggtggaggaaagagcaatgtagaaagattcattttcaaggcataaatagtaaaacgattttaggacacagtgaaatattccctccgccagtattatcgtggaagaaaattgaaaacgggtgttggaagggagatggcatattgccatctgtagaaaatggtaattaatagtatatacagaaataagtaaaaaattttattaaacaaagggagtgacatggtcagaattaatttgaagattattttcatgctagcttctatgaaccgttaatgtgaaaagcgaacctgtacctcagcaaaaaaatcataattggtcaaaattatttaaaacaaacatttaacccccttactcatagggcagaagctctaccccaggcacaacaggctaagaatactggggacctagtggcccttgtcccagctgctcattggctggaatttccacactaggagaagcaagttagaaagaccagaggctactatgccacccagtgttctgcagggctatcatgctagttatctgctgcagagcaggcgctcagagagtttgccaagtgagaagaggcagtcagtaagaaaagagacctccaaatccctctccaaaggaaaagactttattgaaacagagactgagaaagctcaagcctaaagttgctatcaacaacaatggagattttggtggtgagcagagaagttagtagctcaatgagactgtcaagctaaaccacaagccaggtagtttaccagagaagcagagaaagaaacaccctgtgtagtgagaacaaagctcaaagtctagccttgaaaaggattcctagaaaggtgcagtttacaattcaaagtattgtcaaaaaatgtcctcaataaaacactagcaaaccacatcatgcaatatataaaacagagtatacgtagtgaccatgtacaatttatctccagaattcaaagttaatttaatgtccaagacacaataatgtaaaacatttgatatttggtattatcaaaatatagaggacaaaaaatgcaatcatctcaaaaaatgcaggaaaattttttgaaaatattctacattgcttcatgacaaaaacactcaacaaatcaggaatagaagaaagtgcattcaacctgacaaagtatctatgaaactttcacagatatcctcatatttaataatgaaaaactgaatgatttccctaaaagatcaaaagaaagataaatatggcaattcctaccacttctattcaacattttactggaggtcctagtgaagtcacttagcaaagaaaataaaataaaaggcatccaagttggtaaagaagaaataaaactgtctctatacatggataatataatcttgcatagtaaaaatcctacagaatccactaaaaatgcaaatagaacaaataaattcactaaggttgcaggatacaaaatcagtacagaaataccaattgcatttctatatactagaaatatctattctactactatatagtagtaatgagtcatcctaaaattaaaatcagggcataattttacttgcaatggcatacaaaagaataagatacatagaaatgaatttaacaaagaagtataaaacttaaactctgaaaacaacattacattgctgaaagacacaaaaatcctaaataaatgaaaaaacatctcataatcatggaaaagaagacttcatattgttaagatggcaatacttcccaaatttacctgcctagtaagtgtaatccctattaaaatcccagctagcttctctgcagaaactgacaaatttgtcctaaaattaatatagacattgaaggcatgcagaatagccaaaacaatctttaaaaagaccaaaggtgaagctgacacttctatacttcaaagcttaaaacaaagctacagtaatcaaaggaatatggtactggcataaagctgggcatatatatcaatggaatataacatagagttcagaaatctaccttcacatttatgcttagttgatcagtagatatgccaagataattcaatggggaaacaatattcttcagcaaatggagctgagacaactgaatatccacatgcattagaaagaagatagatgtatacctcataccatatgcaaaaattaagtcaaaatggaagtataagagctaaagttttaaacttttgtgatctcaaaatagggaacggtttcttgaatataacaccaaaagcaaaggacgagcaacaaaagacaaaatagataaattgacttcattgaaaaatatttttgaaagtttgtgtttcaaaggacaccatcacaaaaagttaaaagacaacccacagaatggaagaaaatagttgtcaattatgtatctgttaaggggattgtatctagaatatatgaagaaatctaacaaatcaataatgtgtagataaatagcccaatcttcttttttattattattatactttaagttttagggtgcaggtttgttacatatggcacatgtatacataaatagcccaatctttaaatgggcaaaagatcggagtaaacatttctccaaagaagacatacaaattgcaaataaacacatgaacaacgtttgatatcattaaccatcagggaaatgcaaattaaaaccactatgagatacaacttcacatagtatgactattataaaaaagacacataataacaaatgttggtgaggatgtggagaattagaaccctcctacactgccattgggcatgtaaaatggtgtcactgctttgaaaaacaatctcgcagttcctctaaaagttaaatatgaagttaggctatgacccagcaattttgctcctaagcaaatgcccaagaaaaataaaaatgtatgtcaaacaaaaattatacaaaaatgttcatagcagcaatattcacagtaggaaaaattgaaaacaacccaaatgtctatcaactgataaatggataaataaaatatggcatagctatacaaaggaatattgcttggcaataaaaagaaatgaaatactaacacatgctacaacatggataatccttaaaaacattatgataaatgaaagaaaccagtcacaaaagaccacatattctatgattcgatttatacaatccaaaataagtttgtccaaaatagacaaatctatatacacatggtaaatttgtggttgtcaataccacagggagttgcggggaggaaaactagggaatgcctaataggcatggtgtttttggggggttgatgacaatgttttgaaattgattgtggtgatggttgtacaactgtgtgaatatacaaaaagccactgaattattcactttcgatggattaattgcatggtatgtgacttatatcaaaataaagcttttattataaacaagaaggatatcccacatcagtgagaatggagggaataagctagaagaaagaggggccattagaagattaatatatttcttctgatgggacacattgaaaataggatctagacaaatgtaagcaaagtcgtatatcagatgtaaagcatacttgtgactagataaaagatgtttctcaattgagaaatcaccaatgagtttgtactttggtattttttcttatacaatatattgtattactacaagaaataatttatgtttcaaaagatagctgaaaacaacttcagcttttaactttttaatttctagaaattatcatattttggtctgtttattgcattacacttgcaatgttacagtggcagttctttcctcttggaaagttgcactttataaaatagagcatcttgtttgtgtttccatttgcaaatacagacagacatctaaaatttcacagtcatgttctattcatttgattattcaagtactaaaatatgagctttctggatatttcagcaagaacaaattcttcacgtttccatagtgacaattaagggaaaaattagatgaaattgaagttcagagaagattaacagaaattaagaatgcttattaatgaagaaatactaaacaggagagcctaaatatggaaagcttagaaaagcagaaaattaagctgaaacacacttatatacaaatacctgacagatgtcaaaagagggagcagtgatacatagaagccaaaaataaagataaataataaacaatgtcatgttaataaagaaaataacatcaaaataaaaactgaaagagtaagttaactgatagtataaactgtagcagaaaaatctgatattaaaaatgattgctagattataaattataaaaaatgtttttattgtacattagtatagaagaataaagttatggtaatgatgacctttaagaaacagcattagcatactttttattactttaagaagcaaagaatggggcagctgagcaaagagatacacattctatgctgataatcacttttcagagatatgactttgggagatattacataacctcagcaggtttctttccaatattcatgtctcctaatattgacctctatggccagcataaaatgagcgaagattatttttatacagtaatgcaatatctttcattatagagtgaagtgagttttggaagcattacttggagcacataattcttattcattgtatttcacttgctaattacaataatggagatgcgaaatttctgttgcatctatatctttcctaatatgggaataatatatgccatatgacacagggacaatagtgaacgttcaaaggtatttgaatatccatttttttcctataactggccattaactttaggcaatttactagttgtcttcgtttctttaactgaaaataccactttctccttggccttaagtggagatgttcagcctatgcctcatactgaagggactaataataacaatttaacaaaaaagaaaaatacttacaagcaatgatctttagatttagagcaagttcccattttcctgactacctggatttttattcccttgcttcatattttagcttctgataccaatcttagattatcctagatgtattgattaattttatttcactgatttgcaatcttaacccgccctactcaacacttaattctatgtacttcaaagatgaaatttaggcccgtcgtgatggctcatccctgtaatctgagcattttgggaggttgaggatggaagattgcttgagcccagaatttcaagaccagcctggaacactttaagtaaccaaatgtgtggtaaaataagacacaggttgtggccatggttgaggtattatatggaatctgcaatttgtgtatgagagaacttttggtgacggcaaaagaaaagctattctcgttcaaaattataaaatacctaacattgcatgctaagtagtttcatgttcactttttgtatgttttaaagtagatgaatatcacgagcattaggagaaaaagaaaaacagtaaaatatgaattctaagggaggactctgtttcactagggcggttgtaattcacactttcaaatgaagttcattaagaatgtgataaagtatttgatggttaagtctttggtgttctttgggaatacaacttcataaattggtagacacgaaagcaagaataagtaaattatatttcctcttgtggtcaagatagtgtagaagagaccaaatttactttctgatgaaacagctaaaaagtcaggggagaaataaaacaatagtttgcaaggctaacatcaagctggacatcaaacagcagagactgatccctgagagatgggaaacaaatgaaatgggccctgtagttgccccagattatttattgagtttctgggccattgctcatggaaggagaaaaacaggcagagactagcagtgtcactaagttcagaagatggagctaagacactccagagaaaaaggtaagtagaattttcaagtcagagtaccagagaggagaataatgtacagagaaagaacttcagaaagttgcaaagtcctactctcaagttaatgcttcagcagattactgatcaactcatgtatgtgagtaaatgacctaaggccagggcagaaactgtttacaagaattatagatagtggtctctgacactcacacagagtcaagaacagtgacttttcctgttggccagtctagagaacctcaagattcaaagggaattggaaaacgtatgcggaagggtattgccacagtagtggggaatatttagccatagattgagcactgctctatttctgtcttacaaagtatttttaaaaaccccaaaagtaacaaactatctccaagcaacttaacagcattgtagaacaaaagtcaaaaacattcataaaagtacattatccatcagccaataaggtaaaatttacagtgtttggtatctgataataaattgccagggatgtaaagaggcattaatcttcctataatgaagagatgagataatcaaaagacgtccaaaattaacaagatattagaattatctaaaagacattaaaataattgtcataactctactcaaagtgttcaaaaattaagtagtgaatcagaagatataaagaattcttaaatcaaacttctaaaagtgaagaaagtgtaagattaaaaaaaattgggcattcatgacatgtaagacattgcaaaagaaaagattagtgtacttgaagacttggcaagataagtcatctaaaataaaatgcaaagaaaagagaaaatttaaaaagatcatagtatcatttaggtgtgagaaaacttcaagcaattcaaatatatgtgtaattgaattctctgaagaagagatgaagggagaacagaaaacatatttgaagagacaatgacaatttttcccaaatttgatggaaaccaacaaatccaagaatttgtacaaatccacaccataagaaacataaaaaagacaccaaaccacataattatattgcttaaaaataatgataaacagataatattaaaagcaaccagggccggccacggtggctcacgcctgtaatcccagcactttgggaggccgaggcaggtgaatcacgaggtcaggagatggagaccatcctggctaacatgatgaaacccgtctctactaaaaatacaaaaaattagctgggcgtggtggtgggtgtctgtagtcccagctactcgggaggctgaggcaggagaatggcatgaacctgggaggtggagcttgcagtaagctgagattgagccactgcactccagcctgggcaacagagtgagactcagtctcaaaaaaaaaaaaaaagcaaccggagaaaaatggcatgacacacaaagaaaccaaaattagggcaaaatcagacttcttggctgaaaaatgcaactgagaaaagagtggagcagtctatgtaaaatataaatttaaaaaaatcaaactagaagtctacaaacaacaaaaaagcatatttttaaaacaagacaaaataaggacttttcagccatgcaaagtgaacaaattcatcaccagcagaaatggaatataaaaaatatgttgagtaatttgcctcaaacagaaagaaaattacagcagtaggaaataagggtctacaaaaagaaatgaagagtagtcaaattgataactccatgagtaaaaatgtaagattttttacaaattaaaataaacagaaaatgtaaaataaatagtgttgtattatttaagcaaaagtaatttttgaaaaagtactgtggattttataacacatataaagcaaaatgcatgccaagaaaagaacaaaatgggaggataattaaaatagaaaacagaaaaacaacagagataaatcaataaaatgaaaagctgcctcattcataagattcataaaacctatgaacctctggaggggttccaagatggccgaataggaacagctccagtctacagctcccagcatgagcgacgcagaagacgggagatttctgcatttccaactgaggtaccgggttcatctcactggggcttgtcagacagtgggtgcatgacagtgggtgcagcccactgagcatgagccgaagcagggtgaggcatcgcctcacccgggaagtgcaaggggtcagggaattccctttcatagccaagggaagctgtgacagatgtcacctggaaaaccgggtcactcccaccctaatactgcacttttccaacagtcttagcaaacggcacaccaggagattatatcccgtgcctggctcggagggtcccacacccacagagcctcactcactgctagcacagcagtctgagatctaactgcaaggtggcagcgaggctgggggaggggcgcccgccattgctgaggcttgaggaggtaaacaaagaggccaggaagctcgaactgggtggagcccaccacagctcaaggaggcctgcctgcctctatagactccaactctgggggcagggcatagccgaacaaaaggcagcagaaacctctgcagacttaaatgtccctgtctgacagctttgaagagagtagtggttctcccagcatggactttgagatctgagaacggacagactgcctcctcaagtgggtccctgacccccaagtaacctaactgggaggcaccccccagtaggggcagactgacacctcacacagctgggtacccctatgagatgaaatttccagaggaacgatcaggcagcaacacttgctgttcagcaatattcgctgttttgcagcctccactgctgatacccaggcaaacagggtcaggagtggacctccagcaaactccaacagacctgcagctgagggtcctgactgttagaaggaaacctaacaagcagaaaggacatccacaccaaaaccccatctgtacatcaccattatcaaaggccaaaagtagataaaaccacaaagatggggaaaaaaacagagcagaaaagctgcaggctaatcttatctaggtacataaacactcacacacacatgcacacacacacacatacacacacatgctcctcctgcattcctgactccagtcaatattccttttcttacctctgtgtctgtcttgtgtcttcatacataatcttctctattgttaggacatcattcagaccatgtgatcctgtttcagtgtctccccaccgaagtcaatttcatgattacttttattaagatcttatgtctgtagacaaggacactcgttttccagttgtcttccactaaagaacttacttcaatatcctagagaaatgagtcattaatgccttcaaattctgagaaatccccatacttatttattctgacttctgaggggccaataccatgccttatggctcagagttaactggtttctgaggttgtccactgaagccttggacttcatgcagcagcattcaatgtttagttctcttcaacaagagacagacctacttttccacatttggttatgtgaccttgcacttcaaggaggatatatccttatctacacaatggacaccatatcatcaaactcaaattctggtaagacttaaaggattacttactggagtgcctaatgcctcaggcatcatagaattgatactcaacatatatttgtggaagaggaggatgaaataggaaaggaagaagggtacaaaaaatcacagcagaaagagactataaaagtaactttttgatggtgtttatctggtgatagccttcatctatatcacacataatcttagctgttgcttaagatgaaaaagtggtgcttgctttggctgcacatatactaacattaagatgaaaaaggataattgcaaaataaaagccactggttagggcttctattgcttattggtaatggctacttccagggaaataaactttcctcagagaaattatgtgagtttcttcatactgtaatcacacccattggtattagttgtcacacagaaataaacagaaacaatgtttgatctatttggatttttaacaccagttagacttctgaaaacatcctgacttcaaatccatagtttttagaaatacagggaattcaagagagcttaatatatcattgtgcctgtgtagcctaaagctatgaatgctatattccataaatactgtaataatcaactgtattacaacatcacataggtttaataaaggctttggagaatttgactgtaggaacgtgtgatttaacaaatatcaagggaattatttttcatttctgagagtctgcatgaatgagcaaggcctttggggctaggcaaaaatgagttcatatcccagtactgccttgttcttatcctgcagctataggtgagttgccacatagaatctctgtttctttactttaaacataaaatagaaatacccatttcactcgaagttttgaatattaagtgagatatgaatgattgtacatgtcttggttgtgaattaattttgcctcttttctcttcatcatttgggaatgagtgaagttgtgttaaacgtgaaagatctctttgcttttcatttccaatgtgaaaaaaggaaacttaagaaaacattaggcaaaacttgattaatttctttaattctaatgtttagacccaatatatgtgatgaaagaaatactgaattgaattggaatatgctaccaataaacatcttttacttgtccattcagttgtatcttaagtaaaataagactagactacacagaaaatactgagaaatgaaattgcccccagggaccatagaaaagtcaactattagtctttgtaacataaattttgagctcaatgggaactgaagaaagtgtacctcattgaacatcagaagataaacaatatcggaaatatgcttcttgctaacactcaaaaacatattttcaggcagtagactagcgattaaaaacttagtcacagtcgtatgctattgtaatctaaaaagtgaccattattactttatcattttcaaattcttcctgacagtggagttgagtaaggaggaaaataaccatatgctgttaatatcacaagttataaatacttaccaattcttgcatgctatcgaaatatagaaattaaaatcacccttgttcaggataaatgtgacctaaatatatatagaaacacatgtccattctacagcaccagagacacactatgcaacctgacttctttcaatcctaaaacagattcttaaccagcgaagataaagagttaggtcatttaatattatgaaaatggttgcatttctattgactttcaggagccagtccccatgtatacatggaagtcgaagagttccttatgagaacataatatgtacatcaaaggcagcagtgatatgtttcttttcttgataaacactgaaagaatgagccctaattcttgtataatttataagtttgatatgtgagggtcagagtgaacattattttaggtaggaggacagacgggcaaatatgggaaggtagcataacaactgcctaagccccagaagaaaaaataataataatacagttatttactagccccaaaatttataatgtaggtgttgtcccttgtggtctctagcttgcaaactgcttaaatatttgttaaaaataattctgaccccataatatctcaaatcttttctcatttgagtggttgacagctacatgtgattcttttaaaacatttttttattgtgataagagcacttaacatgatatctatcctgctgacaaaaatttaattgcacaatacagtattgtcaactataggcaaaatgttatacagcagatctctacaacttttgcatctttatatcaatggaagagtaattccccatttccacctacccccacctcctggaaaccaccattcaactgtgtttctatgtgtttgactatttttcataccttatataagtgaagtcatgcagtattagtttttctatgactggcttatttcagttttcacaatgtcttccagtttcatccatgttttagcagacgacagtatctccttgttttctaagcctgaataatatttaatagtatattcatatcacattttctttgtccgttaatctgttaacagatattttggttgttaccatattgtggctgttgcaaatagtgctgcaatgaacgtggaagtgcatatatctcttcaagattatgttttaaatgtgtttggatatctacccagaaatggaattactggatcatatgctaattctacttttaattttttgaggaactaccatgctattttccatataggagttccttctatattttgcaccattttacctttctgcaaatagtatataagccttccaattttttcacagcctcatcaacacttatgtttgttgtcttttcataaatggtagccatcgtaacaggtgtaaggtaacatctccttgtgtttttcattggcatttccctgatggttaatgatgctaaacatcttttcatatacctattggtcatacgtatgtcttgtttggagaaatacgtgttcaagccctttgcccattttaaaatcagttttttatttttgttcccattgagttgtaggagttccttcttctttttttttttctttttatttttgagacggagtcttgatctgtttcccaggctggagtgcagtggcgagatctcagctcaccacaacctccgcctcccgggttcaagcgaatctccttagcctcccaagtagctgggactacaggcacgcgccaccatgcccggctaatttctgtatttttattagagatggggtttcaccatgttggccaggctggtctcaaactcctgacctcgtgatctgcctgccttggtctcccaaagtgctgggattacagacgtgagtcaccgcgcctggccgagttttagttccttctatattttgaatattaatcctttctctgatatacaatttgcaaatatattctcccattctgtaagttgccttttcactctgttgattgtttactttggcatgcagaagtatttcagtttgatgtagtccaacttgtctatttttggttttgttgcttgtgcttttggtatcatatccaaaaaatcattaccaagcccaaggccgtgatactcttcaccgatgatttcttctaggagttttacagttccaggtcttacgctgaaacctttaaacaactttaagctaatttttgtgtatggtctaagaaaagggctcaatttaattcttctgcatgcaggtatccagattgctcttccttgttgaacagaccatcctttccctattgtgtattcttggcatccttcttgacttataccttagctaccagattttctttctgtagcctgggggaagtaactatcttctaaaaatcattcaattggccgggcgcagtggctcaagcctgtaatcccagcattttgggaggctgaggcgggtggatcacctgaggtcaggagctcaagattagcctgggtaacatggtgaaaccccatctctactaaaaatataaaaattagccaggagtggtggcgcatgcctgtaatcccagttacttgggaggctaaggcaggagaatcacttgaacccaggaggtggaggttgcagtgagtcaagatcatgccattgcactctagcctgggcaacaagagtgaatctctgtctcacacacaaaataaataaataaataaataaataaataaataaataaataaataaaataaaaataaaaatcattcaattgtactatacattgcatatctgcaatctttcttcattccattttttaaaagaaaattcaacattgtgaactgtcaattttttcacaatctattaattcagattatcagtatatacatttagtggatctgtatccactggtctaaagtaactctaataaaatctactatgaagtacactattactagtgagcctccaagagaaaaaactctgtaatggaaacacgtagacaaaatctaaggtttcttttttgttgctgttagagatacaagacaaatactgttaaaattaaatatcaattcaggacaataatatttaaaaagtctaaaagccttatgaatatataagctacttttataaggttttgtaagctacgttttgaaggttagtccctctttctcaggctaattttgggatttattgattcttaaagctattcatattttgaaactgcactaccgactaacactttcaccagaaataatataaatgaaattccagtgactagctagaaaagaaaaaaaaagtgacagcacaaaagagaagagaaaatgtattatatttgtcttctagacttggagcagaagagtttaagtttaatatgcctcatataactgttttttgcataatgtctcccctatggctcattttcttagttaatgatcaacatcagcaacatgtctttttaatgtgaatgtgaaatttgtgttctacaacatggtgatggcagaagatggcagcaagcttttcaattatttatttattttcacttactttttaaagtaaagtcagcttgccaatactttacaaaatttattattcagaacaagaatcttattgatttagtctttggtaagaaaaggaaaaaaatagtaaagttcatgagactccattaactaataaactgtagttcaatactatacaaaaatacaccaaatatttacatgtaatgaggcttgcaaacacttagccctgtgagctaaatcgattaaaatatatacatttgtaaacccaataaccactacattgaaaatatttcaaatgtttctgagaattagttgtcagtctctttggggaaaaagggttcctggtaaaaacaaatgctttcatataatttggacagaaaacaagcaacaaccaatagagctcactgttgatttgattataatacattttataaaaacataattttatacatttatttatttttagaccctgtcagcagttattctccatacagacagatcttgattgagtcctcttctccttggtagtagtaaggaggaaagctgaagtaaacttagtccacgctttcaggagtgattgtccttcaattcccttcatttaaatcatcccagtcacctgggaaaaagacaaccaagcttccaaattatcactaatgcaaatatatagaaaattcattttgaaattctgaaggaggaaatggagtgggacagtaagcaaataatactctctttctcttgtattctgaatgtaattcttatatttatttaacacaaaaaatcagaaagttctagaaccataccacattaaatttaacaaaattctgttgtaaaaaatatattcccaatgcaatatattctacagtgaatttcttgcatcccttaaactattctgtgccttgatatgctccctaaattatatttagtaaataagtctaagaaattattagcatgaaactggtgcttacagtttctcagttcccatgagttatttaatgctacttgtaatcatatatttaagaaatatgtttagtatttgtcaaacacagtttttcctaagttttaattttcctaaacttatttcacctcacaacagactttttttcaagtaatagctactaaactttcacagaccaagtgaaacatccttgggaaaacattcaactaagataaatttatctgtatttaaaatttagtttaagcaagtaatataaattaatattctgaaataacatattacatttatttattataaataaaaattataatagtatttctggaatttaaatcattagtatattaaataatgcaatggatcaaggcaaagggtaaaggaatccaaaattttttaccaaatgttgagcaaaaggaaacgtaatgaaagatattatagttaattaaaaaatttggtgattaagtccaactcaaaaaacccataaaatcaaagaatataagaaaccaagaagacatcatccaagagacactaatttcttaaatctcagagctgaaaaaatagccaatttttcagagtgaaataagtccatggagtaatgtattgagttcaatggatgaaaaaaaggatccgtaccaagatacatgctgatgaaatttcagagtctcaagaattaagactttggtgcagtggctcatgcctgtaatcccaacactttgggaggccaaggtgggaggatcacttgagcacaggacttccagtccagcctggacaacacagtgagacattgtcactacaatttttttttaaaaaagtagccaagcatcatggcatacacctgtagtcctagctgcttgggaggctgaagtggaagaattgcttgagcctaggaagtggaggttgcagtgagcccagattgcaccactgcactccagcctgggtgacagagtaagaccctgttaaaaaaaaaaaaaaaaagaaagaaaagaaagaagaattaagacttttaaaaaattcagagcaaaaaaaccaagatacctagaaaggaatactcattcatatggcccattctgtgaaataaaactaatatgcaaatttatccatatttttataattctatataaattaacaaaatgactttttaatgaagtaatgatatgagatattttagatagccataggaaaacatgacttctaagaagaaaggaaagctccaaagtaataaaaataagtacattagactttgaaagtcaagacattttcttttaagcagttggcaattagtgcagttgcaatctttgattttcctttgaataatatcaggtaaatttttatttctcttatagtgcttacaaagatacctaggaaaaagcttttttataaaaatttgaattctagacaaattcagcttgcactattctttaaccatatcagtttctcatcacataataattccttctttacatgtgcattcatttttgaataaaaggtttcttatttcccctgttaggcgcaggtgaacgatgttttctaccatttctagcaggtatattttggttcttcctggtaaatgagccatgatcaatgcctctattgcctttggttcatcccctgtaaaatagacacgatatatatttctcttaggtttctcattaaaacaaagaaatggattatgtgtaaatcaagataatctatataacgtgattttgtatagtgtctggcaccagctaagcatccagaaaaatgttgttattttatttagtattactccaatatgaaaataaaaatattcgattttcaatgtccaaatataggagaagcaaaaatcatacagatctatttacatgtcacaaatattttctttgttgattataagaatctatgttaaagtgcaaagatatttagtagatttcataatctaaagttagtaagacaaaatttgatctggatatatttttaactttctaacttggaaaaattccacggaatgtatgctaaattcaagagccaatgcttcaacatttctctttaacaatactccaactagcaaactcatatgagtactctcttttctaaaattggtgaggattagaaaaaaacttctatattctaaataatcccggagtaaaacacacattgaacctcctaaagttcaactgggcatcttcaaattttttcacgtgattgttcattaaaagagtttctgtacttaacagccacttccttttttcacttttcaaagtggaatattatacaagggactcatatctaattcttagaacttaacaataagaaaacaaagagcataaaacaaaaacaatgcacaatgtacagtagtttaacatgtacagagatatatagctaaagaaataattacagatgtgtgtacatagtggttagtatatttgcttatattttatagctgtttgctgagaaactagaaaaaatggcacacaagtatcaacaagtacatccagtacccagatcttggtttctaaataccattctccaaaataacaaaagcaaaacaaaacagagacgtccttggagaaatgagtaattctaggcctggggcagtgaaaacacaagatgagcctggagtattatgtaatgccagaaaatacggaagtgctcagaaaacaaaagaataaaagcagatcagaaggtcacagtagccagaccggaagaacactcaatggccaaagttaaaacaatttaagcaacaaaataagttaaaatttaaaaattataacccaatataaaataaaatttcatgagtccatactgatataaataattgtacaaataaatgaagaaaaaggtacaagtgtttcttacaaataatttcaaaaaatatacgtagatccccctccctccaggaggtggaatttaagtgacctccctggagtgtgggctggattctaaaaaatagtatatggaaatgaaataacactaacgttttggtggagaaacctgacagacctctccttaaccaaatgatcaattttaatatcagcagtgagaagtcaagctgtgatatggtttggctgtgtccccaaccaaatctcatcttgaattgtagctcccataattcctatgtgtcatgggagggacccggtgggaggtaaccaaatcatggggttggatgtttcccatgctgttctcatgatagtgagtaagtctcatgagagcttatggtttcataaaggggagttcccctacacgagccctctctttgcctgccacccctgccaccatgtaagacgtgactttcctcatttgccttccctcatgattttgaggccaccccacaagatctgatggttttataagtgtttggaagttccttcttcattcttctgtctcctgctgccttgtgaaaaaggtgcttgcttccccttcaccttctgccatgattgtaagttttctgaggcctccccagccatgtggaactgtgagtcagttaaacctctttcctttataaattacccagtctctaatctgtccttattagcagcgtgataagagaggaatacatgctggtatcatgtactcctctgataagatgtgaggagaaagacactttacttctatagtattcttctccaaaatctagaatcctagcctaatgatgagaaaacatctaacaaacctaagtccaaggatagtctacaaaattccgaactgcatctcaaaaccataaaggtcatgggaaacaagtaaagggtgagaacctgtcatagactttagattaaagagacatgataactaaattcaatgtggtaggctgggttaaatcctggcaccaaaaaaggacatgggtgtaaaaaaatctacaaatctgaataaagtctgaaatttagttaacagtaatatatcaatgttaattttttagtttaaatgcatgtacaatgtaaaatattaattttaggggaagctgagtgaaatgtacatgaaaaatgctctgtacaatctttacaactgcttcataaatctaaaatcattctgaaataaaaggtttccatgttaaactatatattgcattatgatgaattatcaacaaatcaatattaattatataagaaagaaagctgtagcttctttaaagtgcattcttgtggcctccctccccatatatagtaaatcataattttttgaagtggagccagtcatctacattgtacattatctttaaattgtacacaccaatatatgagaattacttttctagagccttgtgccttttataggccctcagaagactttcacagtagtaaccaaatttggagaaaattaagtttcagcatgtgctagatggaaatggaaaaatcaaatattggagcctgtggacaaaataattatcttagataacatgtacataattggtgggcccacaggataacgaagtcatgatagaagagtaagaagagacaaaccttggggagtagccaaatggtagtaaaaaaactaggagtgaaagcaacttacttatgcaaacagcccttcttgggttgaagaaaactgacatcactgtagagtgcagagaagttacaacttgtatttaaacagtgttgacaatgtatttaaacagtgtttcctttggaagaaaaaagaatcaataacagtcaataatgaaaatttcttataattttacttaaatattcactaagataaaatgagttataaaaatgtgtatgcttaaaggtatgttcttatacctataaaatgaacaatttacaaatattacaaataaaactgtaaaactaaaaattaagaaatttcaactgtatttcacattatgtttttgtcttaaacacaatcacttctcacttgagaatagatctagtttctgtggtgcaagttttcttttgaatgtgccatgcctatataccccgatatacttggagtatcttcattcttgagcactctttcttactgaaatgtttgacacaccttattttatataattattcataatgtaatttttccttcaggaaataaaaaccaccttttaaatattcaccattcgtgttcttttctatgaagttgtgaaaagtaaagtagtactttattctggtgaagtttggttttttttcatgaattaccgtaaagagtctcaagaacttcagcagctgaaggtgctgaagcttctttctggtaatttattttttcatttcctaatcattactttgcagctagtaaaataagtcaacatgactataagggtgaacatgacacaacttcatttttacactaagaaatgccataaagagcagaaatctcacttaacaggattgaaaacacacatccaaataagaacattgaatttttctggctgtattgaaccataaagagatcaagataatcctgaaaatgcttagagtaatttttcatttatatgtaacacaagaaaagatctacaggattatcaaatataaagaggatactgaattagaatggcatgaacacaccatatattcagtaattattttctttaggaaatagtatgttagtctgccagtcttcgtgctaaatgttgaatgattgcaacagacattgactttaatctttgggcccaagttcatgttgtttgccaaaagtgtgtgtgtgtgtgtgtgtgtgtgtgtgtgtattctattatatatatatatatatataatatagagaatatagagaatatatataatatagagaatatagagaatataattatatatattatataattatatgatatatattatgtatatattacaattatgtattatttatatatagaatataatatatagaaaatatatgtctattctttctctctatatatatatatattttactggacctatatatatatgaccaataaatatattcattgctaataagctgataatctataacatttgtactaataatgcattagtcttccctttataaactatgtggatgtatggggcggggtggagtgggatggggggtcttgggccttgttgtctgagggtgcttgggcatctcaaggcataaaaaatgatctggaattcatcctagtggttgcctgtgggaaagaagtgaacagaatgagattgggcagggactaaaataaacaaagggctcttcaactttacatgcaaacttttgttttttaaatatgaaaatgttaacatttgttgattctgggtagcaagatgggagccctggaagatggcatgacagagtacctctctgacaaactcaccctgagtgacagtgacataatgggaatgggctggcatctccatagacttcgtagtaaatccctatagtcaccagtgctgggcatctgtactatttctaccaataaagtagttatatatacatatatattatagtaagtctttagttaatgttgttgataagtttttggaaactgcaactttatgcagaggaacttgtaaggaaaccaattttatcctaggctaattgatataaacaagaattaagttttatggcacatttcccatcacaaaaacatcaccaaacttgtaaataaagacccaattatttctagtattaaatatggaaataaatgtgagctatacatacatttagaagattaatagatacgggccaggcgcggtagctcatgcctgtaatcccagcactttgggaggccgaggtgggtggatcacgaggtcaggagttcgagaccagcctggccagcgtgatgaaaccccggactctactaaaaatacaaaaattagccaggcatggtggcgcgcgcctgtagtcccagctagtcaggaagctgaggcaggagaattgcttgaacccggcaggtggaggttacagtgagccgagattgcgccattgcactccagcctgggcgacaaagcaaggctccgtctcaaacaaaacaaaacaaaacaaaacaaaaacacaagaagattattagatacaagtaagatatttatccatgtattccagttcagggtggagagtggctggcacatatctgagaaactatgggagcaaggccagaatcagctctggccagcatgccatcccatcgcaggtctctctcacacacacatttacgcactctgggacaatgtaaacaggccaatgcatctaatgtgcacaactttagaatgtggaaggaaatgggagtacacggagaaaacccatacagacatggggaaaacgtgcaaattccacacagtgacccctctggaaattgatttttttcctcatcaacattataatggaacaacgttgaacaaataaatgttgaaggaacaacgatatttgagtatacttacatatgcatagatttaatttttgtttatatatatttcatatttatttatttaaatatatgcatttattctaccagcagcggactttattttgaatctcaagacaagattctgaatttttgtcttcctaagatagcctttgctcaaagcagttcagtgattgtgttattgaaaatgatatagctgctttctaggtcttttctgagcctgcttttatttctgtgcttaggttttatgtatctaatttctatttggttttcgttgcttgctaccaagagaaacttagctaatatgtcttattatcaatgcacctttatctgactctgttataattatttatagtgaagtgaatagctcctctggggtagcaaatgacatttttctctttattcctagtagagtctgttgaaagggaaaagtatgaaaaaatgaaaaggataaaataaaaacaattgtctccatgaaaatagaagtgaatgctgctatcacaaccaccccatctcacttggaagtgtggttccatcataatttatggggttttaaaccagcttttttttttttttatgagacagagtctcaccctgccacccaggctggagtgcagtggcacaatcatggttcactacatccccacttcagcctcctgagtagctgggactattggcccacgccaccacacttggctaatttgtgtatttcttgtaaagatgtggttttcccatgttgcccaagctggtctcaaactcctggactcaagagatcctttcaccttggcatcccgaaatgctagcattataggcatcagccactgtgcccagtcttaaaccaggtttattagactctgttctctatcatcatgtcgcacaaaatagcaataggtgttcagtgaaaaaatggattcatggcaatattttagatatatttgtatttatatatttcatgtatttatatttacatattttattatatgtaatctataatattttattatatataatttataaaattttattataatatgcaatataatttattatatattattttatatataaacatataagtatttacatattttatacatatttagaaaatatttgtgttaattgatttagcaagattttttgtttgttttgttttcagtttatattttttactctaggaatttttgatcttcagtataaaaacatacattgtgaatttacaaaaagcagataaaatattcagcatttccccaacttcctaatcatgagatgttttttctaccaaattttacagaataatgctccaaagaaagtaactcaggaaataacatcaaagaatctcatggcgtgttattccagaagcatatacctggcagcttaacggctctttcactgagaagtcattatgcaaaactttcctttgctgtgaaaattccagcacagtaaatttcaaagcaaaaagtggaattcaaggccctcagcatgagagtgtgtagatgacacacacaactattttgtttcctgatggattactcctaacactatataatttttctgttaccctttaattttcatttttaaacgaatggtttctgggaaagatgacattgatatttatccaatacttaaagtagagaaatggttcagggctcccatgtaccttatattctcatcttcctctacctatatattcatctaatcagcagaaagttgttccttttgattttccagaacacactgctgaattttgaccagtaatacaccctttggtcaaaagcagttagtgcctgcattttatttatttatttttattttttggaaaatgtgtagctgctccttctttcatcaaagcatgctgaaattccccgaaattcattaaactatgggaaaaaaaataaggcacatatgccacacagcattttaataataaagatctagacattaagtaaataagtactatgcagcatcttacatgccacctctttcctccagtagagattatcagcattttctatgtcactattcaattttggatggacattcttttgcagtgcattcctctctaggttcagcaaaggacacgttaagcttctctccagccctaaaatgcatgttataattctataaattgaaactgtgttattcccaaacaatattgggcatgaggagacaccaaatcataaactcttgcagctgctttaatttaaatgtatcctcatagctacttccaggtatgcttatattcttataattccaatgaatttggtaaagtacttattttattcccaagcagccattaacataacagaaaactactattttcttaatatggaaaatatgtaatcatttttataaatgattattttatgcctgaaaataacaagatgattaaaaatgcttcttcacaagagcagtgtttcagtctggcctatcttactaaccacaaatttaatttcatgtgtctgctctttggctgtttaattcaacaagcatttgttcttaataaatgagttggtgctggggagtcaaagttaaatgagacatgtacttggcccagttaagtgagatgtattagcagtttgccaattttttaagaataaaacacacgtccaatacgaggttattttaatgaacaattaaatcaagagtgaatctaggaagtgtcttcatttatatttttccacttcatctttatcaaagaagtaatactacacaatcattcaacaaactttcgcaaacaataatgaaataatttttataaggtttgaggaagaatataggccaattgctctttatatcaaaacagtggacttcaaacaaatctaaagcatcatcgtaatgacaattatctgagtaatttatataatgtggaaataatgtatgaaggaactacctattcctgataatgagggatgttacctcatgtcaccctatgtccatttacattcaatgtaattactattgtcattcgttaattgttttctgattgatttgtagacacttcgttcttttcttcctctattgttgtctttgctttgtggttaccacaaggattaaaataaataaataaataataaataaataaaataaataaaaataaacaaaaaaaccttatagtttaaaaaggccacattagaaaaaaacactttctttttaagttcaggggtacatgtgcatgtccgttatataggcaaactcgtggcatgggggtttgttgtaccaattatttcatcacccaagtactaagactagtaccccatagttatttttttctgatccttttcctcctcctaccctccaacttcaagtagtccccagtgtttcttgtgcctctctttgtgtccatatgttctcaccctttagctcccacttataagtgagaaaatgtagttttggttttctgttcccgcattagtttgctaaggatagtggtctccaattccatccatgttcctgcaaaggacatgatcttgttcttttttatggctgcatggtataccatgaggtatatgtatcgcattttctttatccagtcatccattgatgggaatttaggttgaatctatgtgtttgtcacgtgcacgtgtctttatggtaggacaatgtatattcctgagggtatatacccagtaatgggatagctgggttgaatggtagttctgtttttagatctttcaggaagtgccacactgctttccacaatggttgaactcattgacgctctcaccaacagtgtgtaagcgttctcttttctccacaagctcatcagaatctgttattttttgactttttagtaatagttattgtgatcaatgtgaggtgttatctcattgtggtttttatttgcatgtatctaatgatctgtgatattgagcttttctccatatgcttgctggctgcacctgtgtcttcttttgaaaaatatctgttcatgtcatttgcccatttgtaatggggttgtttgattttttttttcttgtaaatttgtttaagtttcttatagatgctggatattggacttttgccagatgcatagtttgcagatattttcttgctttctgtaggttgtctgcttattgagagtttcttttgctgtgaagaagctctttagtataatagggcccatttggcaatattcgtctttgttgcaattgctattggcgtcttcattatgacatctttgccagtttctaagtccagaaaggtattgcctaggttgtcttccagggttcttatagttttgagttttcctttaagtctttaatccatcttgagttgatatttgtacatagtgtaagtaaggggtccagtttcagtcatctgcttatggctggccagttatctcagcaccatttattgaatagtgtgtcacttcctcattgcttgttttgtctgctttgtggaagatcagatgtatgtaggtttgcagaattatttccgggctctccattctgttcctttgttctatgtgtctgtttttgtgccagtaccatgttgttttggttactatagctctggggtataatttgaggtcaagtatatgatacttccagctttgttccttttgcttaggattgccctgggtattcaagctcttttgaggttccatataaattttaaaatgttttgtagtttcatgaatttattttaaggaatagaatagaatctgtaagttgctttaaacagcatggcaattttaacaatatttattcttcctgtccatgagcattgaaagtttttccatggttttgtcaccccgatatctttgagcagtgttttgtaatactcatcgtggagatctttaacatccattgctagctgtatttgtaagtattttatttttttaaggcaattgtgaatgggatttcattcttgatttggctctgagcttggctattgttggtgtataagaatgctagtaatttcagtacattgattttgtatcctgaaatttgctgaagttatcagcttaaggaacttttgggctgagactatgtgattttctagatatagaatcatgtcatctctaaaccgagatagtttgacttcctctcattctatctggatgcgctttctttctttctcttgcctgattgctctggacagaacttataatatgttgaataagaatgatgagaaagggcatccttgtcttgtgccagttttcaaggagaatgcttccagcttttgaccattcagcatgatattgggtgtgggtttgtcatagacggctcttattattttgaggtttgtttcttcaatgcctagtttgtgaagagtttttaacataaagaaatgttgaattttattgaaagccttttctgcatctattaagataatcatgtggtttttgtctttagttctacttatgtgatgaatcacatttattgatttgcatatgttgaaacaaccttgcatcccagggataaagcctgcttgatcatggttgattagccttttgatgtgctgctggatttggtttgccagtattttgttgaggatttttccatcaatgttcatcaaggatattggcctgaagttttcttttttgttgtgtctccaccagcttttcgtattaggatgatgctggtctcatataatgagttgaggaggagtctctcccactgaatttttttgaatagttttggtaggagttgtaccagcttttcatcatacatttacatcatacatctacatcgtagaattggctatgaatccatctggtcctgggcttttttaggtccataggctattttattagtgattcaatcttgttgcccattattggtctgtttggggattcaatttcttcttggtttagtgttaggagactttatgttttctggaattcattcattatttctagattttctagtttgtgctcatagaggtgtccaaagtagtatctgatggtgatttttattcctgttgggtcagtagtggcaaaccttttatcgtttctaattatgtttatttggatcttccatctttttttctttataatctagctagcaacctatcattttttttttcaaaaatctagctcctggctttgttgatctttttaatgatttcctggtcctcaatctccttcagttcagctctgattttggttctgtcttgtcttctgctagctttggggttgctttgctctggtttctctagttattttagttatgctgttaggttgttaatttgagatctttctaatgttttaatgtgagtgcttaatgctatacatttcctttttaacactgccttagctgtgtcccagagatcctgctatgttttatccttgttctcattagtttcaaacaacttcttgttttctggctgaattttattatttacccaaaagtctttcacgagtagattgttgaatttccatgtaattgtacggttttcagcaattttctcagtctggatttctatttttattgtgttgtggtctgagagagtgtttggtgtgaattcagttctttttcacttgctgaggatagttttatctccaaagtgtggttgattttagaatatgtaccatgtaacaatgagaagaatgtatattcattgttttggagtggagagttccatagacatgcatcaggtccatttggtccagtgttgagtttaggtcctaaatatattggttaattttctaccttgataatctatataatgcactcagtggggtgttgaagtttcccactattgttgtgtgggagtgtaagcctctttcaaggtctcttagaatttgctttatgaatctgggtactcttgtgttgggtgtatatatatttagaatagttaagtcttcttgttgaattgaaccttttaccattatttaatgcccttctttgttgtctttgatctttgttggtttaaagactgttttgtctgaaattaggattgcaactactactttttttctgttttccattttctttgttggattttcttcatccctttattttgagtctatgggtgtcattgcatgtgagatgggtctcttgaagatagcatggcctttggtcttgcttctatatccaccttgccactctgtgccttttaaatggggcatttagcccatttacattcaaggtttctattgaaatgtgtggatttgatcatgtaatcatgttgttagctgtttactattctgacttcttgtgtggttgcttcatagtgtcactggtctgtgtacttaagtgtttctatattggatggtaatggtttttattttccataattagtgcttctttcagaaactctggtaaggcaggtttggtggtcatgaattccttcaacatttgcttatctgaaaaggatcttaattcttcttctcttatgaagcttagtttggctggatatgaaattccgaattgtaattttttttctttaataaaatttaatgtaagtctcccgtctcttctggcttgtactgtttctgctgagatgtctactgatagtctcatgggcttcccttggtaggtggcctgtcctttctctctagctgcctttaacattttttctttaattttgtctttaaagaatctgatgattatgtgtcttggggatgatcttcttgtgaattattttgcagagtttttctgcattttctgaatttgaatgttgggctctgtagctaggtttgggaaattctgatggatgatttccttaaatgtctttttcaaatgtcgtccattctccccatctctttcaggaatgccgatgaatcacagatacagactctttacataatcccacatttctcagaggttttgttcattgctttttattctgttttctttattcttatctggctatcttatttcagaaagccagtcttcaagctcagagattatttactcagcttggtctattctactggtaatatctgtgattgcattataaaattctggtagtgtgtttttcatttctatcaggtcagttacatccttttctttataggctattttgtctcttgggtcttgtatcattttacagtgattcttaacttccttgaattgtgtttcaatgttctcctgaatctcaataatcttcattcctatccatattttgaattctatttctgtcatttcagccatctcagcttagttcataacccttcttgtagagctagtatggtcattaggaagaaagaaggcactctgactttttgagttgtcagagttcttgtactggttctttctcatctttgtgggctgacggtccttcagtctttgaagttgccctcctttgatgtttatttttcctctttattctatttgattcccttggtggtttgatagtgatataaggtgggttcagtcgactgactttatttctgaaatcttttagtcaggagataaggctcagctcaagaatcctggactgcatgctttaactctgggtgaatgttattcagtccttgctttgttctatggcccctcaacattgggaacctggagtgatagagaggccaaggtgctcccaggccactggtcacaacacttcaatgggtggtgccacccaaagcacttagcagggaggtggcagcgagaccagttctcatttgcttgtgctggtggcagtgcagtggagtgcactcccattggctgctgcagtgtgctagcaagtgctagggtactggcctctgtgcaggctttcacagtagtggttgatgttagcatggcacagaggggcagggtgccccagctagtgtccatgcaaccatttgtgccagtgttggtgtcagcatgtgggtgaggtgctggtagacacagggttgtgtgcaccctctgttgccattcaaacggctgctgtagggggagctgctgtgggtgaaggtggtgggtccactgttcaccatgcctagtttcgcactggtggcaatgttgggacagaacattggcgagtgaggctagtgtactccatgcccaccaatgctcctatggcaacgccagtgcagtgggggtgaggaggcagcagagtgcactcacacctgcagcagtggcacggcagagtgcatatgcacacaagtgctggcagggaaggggaggccaggtccttttgtgcacatatgcactggcaaagtcatttggggtggctgtgggcaagtgcatgcagacaaattgtcacagagaaggctgcagtgcagggagagtgctggcaggctggtgtgtgtcctcaggcacctctctgctgaagctctctgccagtgaggtgcattccaccagcgcaggaggtatgatgtgggcccccaggaggtactcctcccctgtgcacctgaggttgcactgcaagcaggcatggccaggctggggccttgggacaggcaagcagactgaagggtgctcagttcagcccagcctcatctcacgggcaagacctccctacagagttgaggtctgacagttcccctgggctaaagtttcttatagcagcaagtcgagcctagggaaataggtgtcccttcctgtgctccactatagacactcccacaccaaaccctctgggctctaccctgtctggagttctgcccttgccccttctctaagcagcgctccctgccaactcaagtgtctacggtggtcatgagctatccttctgccaggattccagaggcctttggtgagagtgagttgctccttgctaaaagaggctattttaagctgataacagctgaactttgatcacatacaaaaactttacacttttaccttctcacacattaaaaatgtgttacgtcacaatttatgtctttttatattctgtatctgtgatggttaatattaagtgtcaaactgactggtttgaaggatacaaagtattgtttctgggtgattctgggtgttgcctgcagagattaacatttgagtcagtggactgggagaggaagacccccgcctcaggaagacccactcacaatgttgcgttgggggggggggggaggcaccatccaaccagctgccagcacagctagaaaaagcaggtagaagaaagtggaagaagctgattttttgagtcttccagccttcatttttcccctgtgctggatgcttcctgtcctcaaacatcagactccaagttcgctggctttggactcttggacttacaccagtgttttgccaggggctcttaggccgttggccacagactgaaggctgcacagtcagcttccttaattttgaggttttgggacttggactatgccactactggcttccttgctcctcaacttatagatggcttattgtgagacttcactttgtgaacttgtgggttgattcaccgtaataaactgcccttcatatatacatatatacatatatcttattagttctgtccctctagagaaacctgactaatgcaatgtcccttaagaaattataatagctatttttatttttaatagttttattttgaagctttcatactgaagaataatggtggtcacgtacaaaccaccattacgatgttataatggtattctaaatttgactacgtactttttctccggtgagttttatactttcatatttttttttgttactaatttgcatcaggttcttttcgtgtgaagaagtctctttagcatttcttgtaaggcaggtctgattgtgatgaactttctcagtttctgtttgtctgagaaagtctttatctccctttgattctgaaggacatctttgacagatatggtattcttcgtcgacttttttttttcttcagcacttttgatatatcatcccactgtctcctggcctataagctttctgttgagaaatctgctactaacctcaaacttccttatatgttatgtccttcttttctcttgctgctttcaggattctctttttgtccttgatttttgacagtttgattataatatgtctatgcatcatcttgtttggattgaatctgtttggaaacccttaatctttctgtactggaatattcatatatttctccaaatttgcagagcgttctgctattatagctttaaatgagctttctacgtctttgtctttttttctccttacattgatgcgtgctcttttgaaaacgtaaagacttattctagtctttacagactggctttgtctgggcgagccctctgcttgtcggcccatccagagattctgggtaggctgcctggcatgtctggaggtaggcttgctgctggagtcattgtgcagcctggcctctggtgtcttggtcagcaggtgggaaagcctggcacttgagtatgcagcattagttctgaatcctgaatccactggggtggacctgttaattgcattggtagagataggcctgaaacctgggtccattaatatgggacaaaatccagtatgtgtggaggctggcctgaagtctaggcccacaggggttgacatgacatgggggtgggcccttaacttcagttctctaaggctggcctggcagtgaggtgtgtctggaccctaagtctgcaaaagtaggtctggatcttgggtccatgagggctagactgtagtctgggttttcaggggtgttcatgcagtctcagttcacaggattcgacctgacaaaagggtttcctggagtggtcctggaccctgggttttctggaacaggcctagacctgggccctctggagcctcggtttgacctgatgctgacgctggcatggagccggtttctatggggactgctctggagagcaggattgtgggtgttagcctggatcctatgtccactgatgctggcctgggggcttgttgtgcaggtgctagcctagaggctaggtccgtgaaggcttgcctggggtctgagactgtgggggatggccagggacctgggtgcacacgtgccagtccagaattgtgatctactgggactggcctggatcctgtttctgctggatcaggcctaatccctgggttgctagaacatagtgccacaggtgccagtctggaggcttgggccagagagaccagcctggcactgggaaggcttggaatctgtgtctctgagtgtccacctggtatttgaggttgggctgtggacttggctgagaatagtccagagcctggggccactgggtttaggctggcagtggggtggctctgagacagactccatctagcatgcctggagcctggaacctggaactacaggatctggcctggagctgaggtggctggaggctcagacacaggcactgtctagagtctggggccctggagttctgcctagcactgggttttactggggaattcccagtattggggtccaaagctgggaccattgcttacttccttccccttcccccatatggagggtatctctttccatactgtgctaccttaagttgggagagaggtaaagagggtaacgtgaagctgttcttcctacccttttcaatgtgacttttcttatttctttgatatactaagatgctgtaatctatcacctgtcacttgtgaagatatatttgtacatgaataattgttcaaatttatgcttttgtgggggcacaagtgcttgagaattgcttgagagtcctatttgctgacatttgtccccttgagcttgaatttaaatacatgccatctaacccgaggtcctggacacttacccattattctatataataatgagtaaattggaaatttctgagccctatgattatgacaatgtgacatgatctgttgtgagaagttagtaggggagagatcctagaagcctgatttaacagaaatctcagtcccgtgagatacaactacaacagattcaatcagttaagtgataacaacacagactgaaatgatcaatagtcttaaaagtctaggatttgggggatgtgtctaaaaagggcagttaatttgaacatagagccaatgcatgtggttttctgctttgtattaaagtaattgcactggtcttaaaaggtaaaccctggctttgattgagcagaagtaagctgctgggatcctttgaagacattcattagagatataaaataaatatagaaagacaatgtgtaagtagcaagggattattttagatggctagccgatcaagcatattttaaccagtcaatataatacttagtaaaaaataaacagcatatgagtgaacacagatttttcaatctaacattctgtgattagtaacagagtttaattaacatgttgctaccaatctgaaactcatattttgagaaaagcttttaaatttctttccctcctccagaggactctaggaaagtatgaagaaacatcttttttttttttttttttttctttcctacattttcccgaaatttgcttttctggttctaaacatcatagaattggaatggcagtttccaggagttattgttagccaatgaagttagtaaggacgaatttataacaggatacattcacagagttaccaatgctttctataaaaatgaatctaaggcttttgttttctgtcggagaaaacaaaattctgtctttacccaagaagaggaaattcacagtctaggtgaagagggtgagcaaatctaggaggccagggaagagatattggaattgtctattttggggttcaaacaggacagcaggtagatgtgtataggattgtaatgaagattaaggcactagacagaacaaagcaagtgaagaacaagttcacaaagagcaagaaacatggaaaggtggaaagattcactgtttgaaatttgggtggtggtgctctgctgtcagagaaatgggaacttggtcatgagtggaaggagaaaagtggagattgcaagagctaataaggtttaggaagtgagttaggaggttatccgaagtgttattagcatcagtgtggactcttctttctgtatccgggcaatctgctctgtgttgtgaattccatgcctgaaaggtgccaaggtcttacataataattatatgatacataatacattaactacatttccatatcactttataatgtgatgtcacagtggtcagtgtctctttcttcttatgagccctttcttattataacagcaccattcatttagacgttttcccttgttgtctgtgaaagcatcttaagactgtgaaagatgaagtgaaggtattagatattaaaatattaagacatttgcaaaacagtaaaatttgatatgagaatgtcttttaggtttgagcaaagtccgtttgaaattctcattttgaaaacatacccgatttaactgatttagggcctgagggcattaagaataaatggaacatagaatatatatgaatgggttattgaaagaaagcaaggagttctgggattgggcttcactccttcaaatgattgccatgaacttctttgggaaacaaatatatatgtttgtcttaggtaactaagtgcatcaagccacagaacagcagccaccaacagtttgtcatggccaagcagcagcagttcagtggctctgagtggtgaaaggaacatgacatgagtgtgtttgtggagattccagaactacattctcaatgctacctgagtcagcaattcatttgccaattgtataaaattcccagtactactgatttatttatttttcttttaaaaggaacataaaattctgtattgttttaagttaaaaaaatccacctgtgcttatcaagctaaataagttgatttttgcatcacagttataaaatgtgtaaatgtgtatcactgtttttacttgataataatatatctggttatttcatttttgttggaacagagtaatatatttaacataaaatataaattagaatataaagttcacagtgggaactgaaattattgttagagtttgaaaaatgagataacatttatgaaattataactatttatcactgggcttcatgttcaaagacatctgctgatggtgttcataatctttcaatgtgggtgtgattaagacacaaatatgtgaatagaaatgtaaggttatcttttaatatctttaaattttttgactactatattattttcaaagacttattctattagcaagtgtgtattgttattacattaattttctttaagtgagggactgcttaattgtgcacttttaagatatgtcatttccttttcttgtgtttaggaaagaatgactcaaaggcccacagagttcttatgtctagaaattgaataatttggaaataaaagtaaaacctccctttcctcagtcaagttcctgaatacaaaattgacaaatgttttccttaaaacagcacactactgggctgatttaatctctactgcttttataagccagagtataatttttgaagggtgttttagtgtgtccttaaggatcttattgtacctgtcttctttatagttcttccaatttggtttgtcaagctgtagcttttttaagccacatattccttctatcacgtacgtgctgctagtactaaaaatgattgctcaaaacaaactcagtgaaaacaaaagtgaattatattcttgttgccttaaataccattcttaaagtggaatcttaccgcaatctatcaggtttattatgcccagcagacttatttagaatatccagcataatcatctgcctgtagccattaatgccagtatgcaggccctgtcacagttttagaaatactccaagccttgttggagaaggaagtcatgattgcaatcaataatcaagttcacctggctactcttgtagtttgactttatgtcacagtttcaggaacttagtttctttttgagatcaagtccttaccttatgactcagttatttatttggactctaatatcagtcctgatcttgataaacaacgaagcacttcaataacttcaggactggaagtctgattttctcatgctcccatctctgctactagagacctgattcttttttttttttaatttattttttatttttatttatttatttatttattttattatactttaagttttagggtacatgtgcacattgtgcaggttagttacatatgtatacatgtgacatgctggtgcactgcacccactaactcgtcatctagcattaggtatatctcccaatgctatccctcccccctcccctcaccccacaacaatccccagagtgtgatattccccttcctgtgtccatgtgatctcattgttcaattcccacctatgagtgagaatatgcagtgtttggttttttgttcttgcgaacttcaaaccatatggcacggggctggattcctgtttactcttatgtcttaacaagtagtagcctgccagcttaatacatctcaatatattccttcctggaggtccctgttatttgtacctcatatgccagctatgtcacctttactacagctctgcaggatgatcagttacctgttattttctctcagaataatcgacttttcctgtctagctggacttcctcacctctccagcaacattttctctggtttcaggtccaaactctgtaggacttgacccctgtcttgaaattaaaccttctgtgaaaaaccattcgacagaggaaatttaaatcatccatggtggtttgcattatctatttcaagatctctttgtagatggctatcaaaaacatttaatgttatctattatgtattttgttcaaaactttctatgaatcttctattatctctgaaaattatacattaatatctccaaaattcactagctataagaggtataaaaatatagataaaatattcagattctttaaaaatatctcattttaccacatataaaatatatctatcaaaaaagtataacatttctgtttaatctgttagaacatgttatctatttaaatgagtcattataagtctgttgtgtacaaaaaaatcagttaaaacgctgcaaaaaaaaaaaacccagtgcctctgttaagatgacattcaaattagtaaatgaagtaaaaaaagaaagaaaagtaagaagtacagagcagaaaaaaatatgaacttatgctggcttctttcaacatcaatagatttaaaaaactggaactaagttgaatttgatacacatattcagtttgtgcttgaaaatattttttctctagaaaaatgaaattttttaacattaagtcccttatgccaacttcactaatagtctaacctgaggaagacatgttactttcttaaatatgccacacattattgtcttaaaatgacatctgacataaaacataagaagtaaattcataataatgtggttcagaggaacatatccattgctggaacagtaattgtttggatgccacttggaaaaataatatcaaacaaaatatgaatcttcaacaaaagtcttcccatgtttaaattctcctaataaatggtaacacttttttagaggcggcatatcaaggatttaaagaatttgtgtgagaagagaactgagtaaacaacatccatttcttccatgtatttgctgtatgatctttgacaagtctttcctccatttcgtcatttgcctgcttatccatactttttaaaaatactgaatgagttcatttatataagctgcttaacagtgtgcttagcatatggaaatgcctaataaacagtagttagcattattgttataattttaactatgagtaaccaacacatttctgtagttattatttgttttcatttgtattaaaatgctctgaaatgccattaataacacataacattttatcaccgattctatgtgtgggatattttaaatatttaatctggctgtcgcattttgcttttgcagaaggtatgttgagatatgtagaaaagacaaatgaaaacatttttaaaaggtttattttaagtagtttatttcttgacaatacattcagagcacaggaaaattgattctttcacatgcattctttaaaacctcttgcccaaagagcctatagcatcattcatcatttcctactgtttctacatccatcacatcgttttcctttgctttccatatgacctccttatttcttctagttataatagcaagcagaactaatcatgaataaattcaaatttgggacaaaggagaagctcaatggccagatgagaccttaggtctctctggcccatggccctagggtaatcttatctatcatgagaaagagtctgttatatcccagctgtgcacaaggctaggctaggcattagagtaaattaaatgggcatgatctgccagcctggtaagcatcttttttttttttttacctttcattttagtttcaggggtctatgtgcaggtttgttatataggtaaattgcgtgtcttgagggtttggtgtacaaattatttcatcaccgaggtaataaacatagtacccaataggtagtttttcaattgtcaccctcctttcaccctacactctttagtaggccctgctatctgttgttcccttctttgtgtctatatgtcctcaatgtttagctcccatttacaagtgaggacgtgcagtgtttgtttttctgttcctgtgttagtttgcttaggataatggccttctgctacatccatgtttctgcaaaagatatgattttattcttttttatggcttgtagtattccatggtgtatatgtaccatattttctttatccagttgaccactgatgggcatttaggttgattccatgcctttgtgaattgtgaattcactattgtgaatagtgctgtgatgaacatacatgtgcatgtgtctttatggtagaacaatttgtactcctttggttatatacccagtaatgcaattgctgggaaattgcccataaaactgctttccatggtggctgaactaatttgcattcccacaagcagcacataagcattcccctttctccacaaccttgacaacatctgatattttttgactttttaataatggtccttctgtctggtgtgagatggcatctcatcgtggtttcgatttgcatttctctaatgattaatgatattgtgcatttttttcatgtgcttgttgagcacatgaatgttttcctttgaagtgtctattcatgtcttttgcccacattttaatggggtggtttgttttttgcttgtgaatttattcaagttctttatagattctggatattagacattcgtttgaagcatagcttgcaaatattttctcccattctgtaggttgtctgtttactctgtttatagtttattttgctatgtagaagcttttagtttaattaggttcaatttatcaattttgatttttgttatgattgctttgggaatctttgccatgaagtatttgccaggtcttatgtccagaatggcatttcctaggttatcttcagagtgtttagtttttggttttagatttaagcctgtaatccaccttgagttaatttttgcattaactcaaggggcccttacacccagaaggcatctttaagtgttgactttttagcatttatcaaatctcccctgtgctgtctctgtcaaaacaaattaagggcctgctttgaaaatccttgtgtcttaataagaccaacaatatatgctgatagccagagtaaaaatatgtagcagatgctaggcatagatttatgtatttcttggtaaggaagaaaaacaaatagagtatgttcctccttcttctctgtcgtagcaccatgacactgatgttgctgacttaaattgtagacggtggagagaaatttgagacaacatggtaatagaaactcttgaaaacacatccctatctctccttttactcagaaactccctttttagttatcattttctctgtcagtcagaaaacttgcatcaaacatatttaatgttctgagatttatgctttcctgagggagcatgatagaatataatctctgccttcaaaaatctgtgaattcttcacattcagggagaggagactcatctacttgaaacaataaatgaacagtccaaataaaatattttaaattctacaagttatcaaatacacaacagggacagaatgcaattagaaaagcaataaatcagaatagactagcatagttaatgtttacggattcaactaaattttaagtgaaattttactaacaaatttaaaacattgtttacatatggttgttttctttatattcatccttatctttttcttaaattaaaaaattgtcaaataatactcaggatttgcaaattaaatttaaataaaaaagcacaatgagatgatcaccttcataaaataaggaagaatgaaaaaaaagggcaggtgtcggcatagattgcacagtcttgtttggggtgacaacattataaaactagtgatcaattgatggtctatggaaaactctagaatttaaggcatttagtgagcagaagagaatccagaagataatccagaaaatgaagttgtcataatggtcagaggagaaccacgagtatggagggcccagagtgtttattttctatggttttgtaaaaaattactaaaaatttagcagcttaagataacacccatttatgagatcacagttctgtaggtcagaagtacaggcacaatgtctcacaaggataaaatcagggtatcagccaggctggcctgtgatctggagacgctggggagaaatctgtataagttcattcaacttgttaacagaattcaaatccctacagctgtagaattgaaatccaaatttcctttctcgctattggtgaacaacccaagaatgctcacatttcttcacacatgcctccctgtctccatctttaaaccagcatgggcatgtcaattccttctcacacgatgcatctctctgacttttctttgtgaagccagctggagaaaactctgtatttagagggatcacctgattacgtctggcccacctggataattttcatatttcaaagttaactcacttgagactttcattatatctgcaagatctcttaacaacaatacctagattagtgtgtgattagataaccgggggcaaggatcttagtgtggatgcatctttagaattttgcccaccacatccagtcatcaaagaaaaatgttttcaagaacatacaaataaaaccatgtataaatagctaaagtaggctaaaggaggtcatgtactaattaaaagccactgtactgttaaatctggtggaatatggtgagctttgagtgagctaattctaaaaacttatggagttgaagagagtattacaagagtaataaaactgcaaggaaataaagaatacatgggtagttggaaagcatatagcatagtcaagaaaaaatagaaatcgatgcctagatgcattaagattaaagttgaagaaccccaggaaaatctttaaaaaaaacactttaaaaagataaattactggagacaaattagaaataaactaacataaaaactaaacaagaaaaatcaaaacaaacaagaaaactcaacaataatcatggaagccagaagatagtggaatattattttcaaatttttgaggctaaaacaattgtcaacctattagtgtttgcccggaaagtctgtttttcaacaaggagagggagaaacaaaaatacaaaaacaaaaaaaaaaaacttttttttttttttgagacagagtccagctcttgtcgcccaggctggagtgccggcggtgagatctcggctcaccgcgacctccgcctcccaggttcaagcaattctcctgcctcagcctcctgagtagctgggactacatcccaccaggcccagtttttttttttttttatttttagtagaggcagggtttcaccatgttgaccaggctggtctggaactcctggccttaggtgatctgcccgcctcggcctcccaaagtgctgggattacaggcgtgagccaccgtgcccgaccaaaaaataattttaaggtacacaaaaactgagagttttatcataattaagcctacagttaagggacgtctaaaacatgtacttgctaaggataatccttaagagtgaaggaaaaagagatataaatgtacacatttctaacagatttttttgtgtaaaataataatagtaacaacaacagcaacaataatgagtctaaaatgtggagcttaaaaaagggctgatacaacatactcaacacaatataacatataacaacatgtcaaaaccttgatgacaaaaattaaagagtgttagtgtcttcacattattcagcaagtatttgaattactaattttagactatgttaattaattaaatatacaggatgaaatatctagtataactagtaaaagaaaatctctgtatattttcaaaaccagtagaatgaaaagtgatatattaaagtgaacaaacaaatcaatccgcaaaaacaaataaaccaaaaaaaaaaaaaaagcaagaaaggtaaaaagaagaagcttcgagaaaacaaaacaaatataaagggaaaagtaaattcatagaaataaatccaagcattatcaacatttattatacctgttgtcatgtataaaatgtatgtggctagaagcatgcacaccagacaagctagagtcatgtttatcagagaaaacccatagaaataggaacagtaacaggtgtgcatatcttctgttgctcattgaattctaggcccaagaagagttatttcacagtaggcctcagagtctggaagaaggttctcacacaggagctgtggagcttttaagtattgtgaatccatgaggaacatcattcccttcccatggcttgatgaggagccagactataattgcagaaccttgaattcagcccggccctgcaatctcagcattcatggtaggtggtatccattttccaccccttccagttcaagccatgtgattgcagagatacatatcaacacagcagcaatatttgacatgttttcttcatataatgaggggctgggatccaaactttaatatgggccaggagtgattttcttagtcagcaggccataactcatttccatggagttttacaggggtgtatgaactcaactcttttttttctggggaccaatctgggaaaagtaaacacttaacactcaataatacataaactaagattatcaattaagacacacattttccaattatatgtaaatatcatgtttcagtcttaggtttttcaaaagagctcacttaaaatccaaggtctagtaaagattgaaattaaaataactaagaaataaatcccaaatgaaattacatttgggttatttatactaatatcgggaaaatacagaagtaagcaggaaaaatttagtatatattaagtgtatataatatatttctatatgaaacaatataagctctctcagaagatattaaaatgctaattcctgtacctggtaaaatacccttacattatttgaagtaaaattgccagaactcaacttgaagtagagaaatccattgacatagtagatttcaatataacaatttctgacaagttgcacatacaaaaaagacagtaaaatacagaaatttaaacaacaaaacataaacaagctttacataatggcaatatgcagaactttgcagcaataattggagaatatacattattcttaagtatatactggacatttacaaaacaccattctcagcaaactatcgcaacgacaaaaaatcaaacaccgcatgttctcactcataggtgggaattgaacaatgagaacacatggacacaggaaggggaacatcacacacaggggactgttgtggggtgaggggaggggggaggggggagggatagcattaggggatatacctaatgtagatgacgagttaatgggtgcagcacaccaacatggcacacgtatacatatgtaacaaacctgcatgttgtgcacatgtatcctaaaacttaaagtatatatataaaaaaaaaagctggccacataattcatacataagtattacaaaatttcaaagacagtttcatatggaccatttaaaaataactcattgatcaaaaaatgaatcataatagagattgtttaaaatacttagatgaccttataataaaatgctacatatcaaaagatgacatgcattgtacaccagaagacattttttaaatagtaaaagcttaaataataaaattaaattatgccagtagtaatacaaaatataagcgaattcctttattatgtagaaatgggtaaaacattccttactataattcaaaatttagaaggaataatggaaattattaataaattttattacgttaaaactgtggatgatataagtgaataaaagtggggaaggaaggagggaagaaggggagggaggacaaatgacaaagttagataaaacatgaaggcaaatatttctataatataaggaactttttaaaaaataaaaataaaaaacccaaaaactgtacgggaaaaaaatgggtgatgatacagaaaactattgtcctttgtagggacatggatgaaattggaaatcatcattctcagtaaactatcgcaagaacaaaaaaccaaacactgcatgttctcactcataggtgggaattgaacaatgagaacacatggacacaggaaggggaacatcacactctggggactgttgtggggtggggggagggggagggatagcattgggagatatacctaatgctagatgatgagttagtgggtgcagcacaccagcatggcacatgtatacataggtaactaacctgcacattgtgcacatgtaccctaaaacttaaagtataataataataaataaataaataaaattttaaaaaaagtaccaacagtcgcacttaattatacaaggtagtttttaatctcatattatatataataagagaaatacaaattgatactaaactgaggtatcatttctaaacttggcaaaacagaacattttgacaacatactctgttgttaagggtgtaaggaaacagtcaacttcatacattgctagaggaaatacaaaatcataccatctcaatgaatttggtaatagcaaattattaatttgcaaaattacatatgcctgtaacctttgacccagcaatcccacgtctaggaacctatcccaaagatacatgcattgaaatatgaaatgacttatacaccaggctatttatttgtctactatttacaaaagcaaaacagttgtaaaaagaaacaaggacaaatgaaatgtgttaaactctttgggtaccttttggggaacaaaggtgtgggaactttacacatacacacactcatacatatgcacacatatctgatattttcaaaaagaacagtggaggataaaccaaaaattaattaaaataaatagtaacctttattgtgaatagtgctgcaataaacatgggagtgcagatatctcttccatatgctgatttcttttcttttcgatatatatctagcagtgagattgctggatcatattgtagtcctttagatgaaaggaagagacaatgaaaatactgggaagaacaaaaataaaagttagttatgttctaatgtgtcttattttataattttgaccttagaaccttgtttgcgtattatatatttgaaagacaacaccaaacacaaaattttaaaaagtgaagcaatccctaaaataaaatgcaaagtgaagctcaccaagttttcttttatcaaattggtggcataatgccaaggatatttatctcaattaaaaatattattttgactttatatacctatctgggaccaaacataatgaccactaaatcttaagttgtatctagtgatattactattaagtttaatgttggtataactttgaaactattataaatatacacactccactacatacaaaggagatttcaacttatgagtaattataccaatattggaaagcaagattttcatatttgaaactttagatcacagaatataaaaggacacggaaggcaactagaagggactctaagcaaagattaaaaaaaattgagcatcaaaagaagaatggcaactgaaatatattgagtctataaaactgataaatttagccaggcgcggtggctcacgcccgtaatcccagcactttgggaggccaaggcaggcagatcatgaggtcaggagtttgagaccagcctggccaatatggtaaaaccctgtctctactgaaaatacaaaaattagccaggcatggtggcacgcgcctgtagttccagctactcaggaggctgaggcagaagaatcgcttgaacccgggaggcggaggttgcagtaagccgagattgtgccactacactccagcttgggcaacagagcaagagtccatttccaaaaaaaaaaaaaaaaaaaagataaattcataaatatacttaatccattgtttatctgttgagattttactcaacatatcagcttattattaaaaaaattcatacaaattcataaagtagtcaataaaatataaatttgtaaaatagtcaataatcaaaataatcaaaaatcaagtgctgcacagcaccacttgggaaatattcttgctaaaataaaataaggtaaaataaaataaaataaaacagttgaacatctagatctaactcacagttacaagaaactttaaagaaaaagaagaaaaaatgttgcatgggaattttaaagacacaaatgagacagaatggtatatgaacaatagaataaataaacaattatagaagttaaaagatgataaagataagatcaaaaattcatcaaattctgaacaaatacacaatgaagataaccaacaagacacaaattagttatttttaacaagataaataaaaatgcacagatgctggcaaaattaatcaagaagcacaacaacatacataaacagccgaggcagaaaaaggaaaaaggcaaaagtagatataaagtgcggattacaaaaaagaaaaaaaaaagatgaattttacccacaataaacgtgagaatgtacacgaagtcgccaatttgctagaaaagagtaacatgaaatttaactcaacaatattgtaataacaaataaattggatcagtattttaaaatttaaaatgaccacaaacaaaagcctcagtggttttcaggcaaattttaccaaattgcaaagaaaagataaatcaaattttgtaaacgtatttcaagagaatagaaaaaaaggaatagaatactccacaactaattcaatgatgacaatatacactcaatagcgaaaactgattatggcagaataagaaagacaaattggaggccaaaacacttattaacataaactcaaagatcctagacaacatattagcaaaaaaaaaaaaacccacagtgtacaaaaagaaaacctccacatagtgaccagtttggcatgactgagttgcatttttataacagtacactgactgctatgttgagaagagactgacatgggagaagaggcagaaggtagaagcgcaatcaagagcaggattgcaaggtaaaatttgtatttgctaaatctaatctagcaactctagttaagcgattattgcaataattgagatgaggcatgttggtggcttataccaagattgtggaagggaagatggtgaaaagtgttcagattctggaaacatttttatgttaaataccacatgatctcactcatatgtggaatctaaaaaattgatctcagagaagtagaaagtagaacagtggttaccaaagaccggggaggatatggggaagagcggaggaggaaacattggtcaacaggtacaatgttacacctatataagaggaataagttctgacactccattgcacagtagagtgactatagctaacaacaatgcattgtatatttcaaatagctagaagagaggatcttaagtgttttcatcacaaaaaaatgataaatgttttaggtgatggatatgtcaattattctgatttgatcattatgcaatgtatagatgtatcaaaacatcacattgtacctcacaaatatgtacaattattacatgtcagtaaaaaatacaacagattttctgatggattgaatatgaattattttctatccttctctctgtcaccacttgccctacattgttctagggttttagcctccattaccgcacttctaaaatagccttctgattgctctgtttcttctaaccctgccccactacaattccaaattccagtttaaataatattcctaaaagtgcaaatctgattatttactacctaagtcttttcaatgacttacttttgcccttggggtaaagtctaactcctaaaaatagatgtcattcactctttggccccatgactacatggccatcctcaaggcactctcttccactaagcaaactccactttctgtctggctatattctatttattctctagttctgaacctaaacatgacattctcaaaaaagccatcattaaggaagattttgttccattgccataggatcccataaaattctagtttctcctatcataacattcatcaagttacattataaccacttatttaattgaatggtttcttcaattgttcattaactttgaggcagtgtgcaatgtaactgtcttgtttattattgtttccctagaccttaaagaacacttgacatggagtacatagccaataaatattttaaatgaatgattaaaaattaattatgtatttgcatttcacatatgcacaatggtcattgagacttccaaattaacaaatgaaggtgcttcataacaccacactaatgatgtcacgagttattatatttgctaacaatttgtccttagaatgagtttattttttccttaacttaaagaatgcatttatattatgtcacaaaacttaattataacagtacattttgacattttaccttaaaaataattacttcaatctctggttaactataacttacttcacttccacaatgtgaaaataaaacggactttttatttctacatgtttcatttaactagcaatcaataagatgacagagaaacacgtacagattggatgatatttctttcttctactataacaaatggtgaaacactaaagtgactctaaaatggaagtcaacgagacagaaggattataaatgaaatgggggcatatttaaaactttggggaaggattaataatctaagtttgcatgtgactgataaaatgaatgtcatatcaaaataaaattaaagatttaataacagcaaactggaaagtgtaaattcatacttttttttttttttttgagacagagtctcgctctgttgcccaggctgaagtgcagtggcgcgatctctgctcaatgcaagctccgcctcccgggttcacgctattctcctgcctcagcctcccgagtagctgggactacaggcgcccgccaccacgcccagctaattttttttttttttttgtatttttagtagagacggggtttcaccatgttagccaggattgtcttgatctcctgacctcatgatccgcccgcctcggcctcccaaagtgctgggattacaggcgtcatactctttttaaaagcagtatcccttctagttctagcactaatttggcccagcatcaattccatcctactaccagagttactcatatggcagcctccaatgcccagaatttaattactaataacttttctcttcctctgtgatatccatcttgggtaatagctgatcctatgatgtggaacatgttatagctacccaaaagtgaggaggatttcaaagatatcttgaatagtgctatcagaacaattgagctcagttaaaaaatgattctcaatgtctaaattctgacaatatatgtgtaacacagaaaatactactgtaatttgtaacaagttgagtctgtgaataaaagcgtgactctaattacaatcataaaaagaaaatttactataatgttgaaaaagaaagttgtaatacaaatgaaaagtgatatcataattatatttaatttactagttaattttaaagataacgggtataacatatagaattttttttctgttaattatctatctatgaagaataaacttatataggtcttaagtcaacttgtttaagaatagtaagaccctacagcaataaattgattgttattcgtggtctttcatcgtatttaggaagaaagaaattttaaatggtttagcaggatgaagaaagaacaaaatatcatgtttctcattgtccaggatatgaaatgtctgaatgataacactaaataaaattaaataacgataagacttacttgtttccaataataataacagaacaaatcaatatgcaatatttaattggcagcaggatatagagcacttgacaaggagagtgaaaggcttggtggctcatgcctgtaatcccagcactttgggaggccaaggcgggcggatcacctgaggtcgggagttcaagaccagcctgaccaacatggagaaaccctgtctctactaaaaaaatacaaaattagccgggcgtaatggcgcatgcctgtaatcccaggtactcgggaggctgaggcaggagaatcgcttgaacctaggaggcagaggttgtggtgagccgagatagtgccattgcactccagcctgggcaacaagagcaaaactctgccaaaaaaaaaaaaaaaaaaaaaaagagagagagagagagagaaacgctgaccagggtacaggataataaaacttaagtgaaaggcttaagtttgacataacagtgtaaactttattattaaaataatgggaccgggacctccaatttgaattaccttaaagggtacaactatatgtatatcccatgccctatttgattagcaattggttggtatccagaacctgcaaattttactggtcttaacacttggcttgtttccaacctaaataccaagataactatcactgtaaactttccatgtctgcttgtggagacagaatatttccgttctattgaaataacttcctaaaagtgaaaatgctcagtcagaagtgtataaacatgctaaatattcaatataatttgccaaattgttatttggaaagttcgtagtaatatacattataaacagtaatgtatctatgtttcctatagatttaggaattatagattatagatttaatcccagttactattttccaggcttatacatttgtgagttgtttcctctgtcttaatcatttccgaagtttttaataaatcctatatatgatgactcgaagacttgtatatctgtcaaagaacccttctgagaaatccagacccaatcaccttactgaaattgtcatttaaatgtctcaaaggaaactcacatttagcaatcccccacactgtacatgtaactttctctccaacactgaacccacctcttctaagatattttcttagtgaaaagcatcaatgtccaataaattgcacacaccaaaaaccaaaaagtttttagtccagtatatctttttttttcctttttgaatttttattttaggttcagggtgtacatatgcagatttgttacatgaaaaaattgcgtgttgcatgggcttggtgtacaaatgatctggtcacaaaggtaatgagcatagttcccaataggtaggttttttagcctcagtctcttcccagtcttcaccctcaggtaggctctggtgtctattcttcccctctttgtgtccatgtgtactcggcgtttagctgccgctttgaagtgacattgtggtatttggttttctgttcctgtgctaatttgcttaggataatggcctccaactctatccatgttgctgccaaggacacgatttcattcctttttatgactgtatagtattccatggtgtatttgtaccacattttctttgtccagtccaccgttgatgggcatctcgattgaatctatatctttgctattgtgaatagtgctgtgatgaacatacacgtgcttgtgtctttttggtagaattattatattccttttggtatgtactcaggaacgggattgctgggtcaaatggtagttctgttgcaagttttttgagaaatctccaaactgctttccacaggggctgaactaatttacatttccaccagcagtgtataagcattcccttttttctgcaaccttaccaacatatgttactttctggctttttaataatagccattctgactggtatgagacaagatctcactgtggttttgatttgcatttatctggtgattagtgatgatgagcattttttcatatgcttgttgaccacatgtgtatcttcctttaagaagtgtttgttcacatcctttgctcattttttaatggggttgtttttgattgctgaattgtttaagttctctatagtttctggatattaaacccttgtcagatgcatagcttgcaaatgttttcttacgctgtttgtttactttgttgatagtttcttttgctgtgcagaagttctttggtttaatgaggtcccacttgtctgtttccttttctgttgcaagtgcttttgcagactttgtcatgaaatctttgccaagccaaagcctatgcccagaatggtatgtcctagattttcttctagggttttaatagtttcagatttcacatttttgtctttaatccaatttgagttgatttttgtatatagtgaaaggaaggggtccagtttcaatcttctgtgtatggctagccagatatcccaacatcatttattgaataggaagtcctttccccattgctcgttactgtagactttgtcagtgatcagattagttgtaagtttgcagctttatttctgggttctataacctgttcagttggtctatgtgtctgtttttgtaccagtaccatgctgttttggttactgtagctttgtaatacagtttgaactcaaggtagtgtgattcctcgggcttttttctttttgcttataattgctttggcaatgctcttttctgtttccatatgaattttagaatttttttttctaattctgtgaaaaatgttattggtcatttgatagaaatagcattgaatctgtaaattactttggtcagtatggcccttttaacgacattgattcttcctatatatgagcaaaagaatgtttttccatttgtttgcattgactttaattatttttagcagtgttttgtaattctagtagagatctttcacctcccttgttagctgtattcctagatattttattcttcttgtggctattttgaattagtccaggatatctttaaactgtccactatttccttgtcatcactgtcgatctaattcatcatctctggagatgcacaaataaaatagcacctttaatgattttagtatattttaattgttcttttaaaatatattccttataccttcaaacactgtgaactttaaaaaatgtgaatccgaacatgtcactaggacacacacacacacacacaccttaatcaatggtttcctgtgttttgcagataaagaccgaaaatattaataaggcctataaggccatgcatggtctgtctcctaccacttcccatacctcgtgtgtaccccatgactcccttttctcctctatagtcacagtgacttcttttgggtctctaaccatgtcatggttactcccttcccaggatctttgaatatacttttcccttcgacccactgaccctaatttttcatgctaatttttagatctcaattcaactaaaatttctaagggatcctttttggctgccttggtggctcatatctcccagttatacatactgtagcacttcctaagtataacaaggagcaatacgtgaaatttggtctactattttatcccaagttcttagcacagtgtctgcacctaataatggtagtacagataattattattaaatatttgatgaatatttgataaataacttatattcatgctggctagaatgtatcttcaagtgtttcatatgagatagatgagatagcatgagcagttcactttctctgccctatccacatgattaacaaactacctgacatatatatatgtgtgcgtgtgtatgtgtgtgcacacgtgtgtgtgtgtacagacatctggcataaatatatatatttatatgccatacatgtatatttatatgccatacatatatatttatatacatacatacaatatatgtatgcatatatatatgtatgtattaattcctttctctgtagaaatatattggattttattttactttctcctgcacttattatgcagaggtttcaaaagtcatttttactctttggagtaaaagggttgtcttcctccccttttgattatagaattattatttttttctcgaaatgttttacaaactcactgggataagatgaggtatttgtctttttttaattttatttttccataagttattggggtacatgtggtatttggttacatgagtaagttctttaatgatgatttgtgagattttggtgcacccatcacccatgctgggtggatgcaccatatttgtagtatttatccctcgccccccttccattcttccactcaagtccccaaagtccatggtatcattcttatgccattgtgtcctcatagcttagttcccacatatcagtgagaacatatgatgtttggttttccattcctgagttacatcacttagaataatagtctccaatgtcattcagatcactgcaaacactgttaattcattcatttttatggctgcatattattccatcatatatatttgtgtgtatatacatatatatacatatatatgtatacacacacacacacacacacacacacacatatatatatatacagcttctttatccactcgttgattgatgggcgtacgggcatttgggttggttccacgattttgcgggtgtgaattgtgctgctataaacatgcatgtgcaagtatctttttctaataatgacttcttttcctctgggtagatacccagtaatgggattgctggatcaaaaggtagttctacttttagttctttaaggaatctccacactgttttccatagagactgtactagtttacattttcaccagcagtgtagaagcgttccctgttcaccgcacccatgccaacatctactgttttttgattatgtacattcttgcaggagtagggtggtatcgcattgtgatttgatttgcatttccctgatcattagtgatgttgagcattttttcatatgtttgttagctatttgtatatctttttttgagaattgtctattcatgtcctcagcccactttttgatgtgattatttgtttttttcttactgatttgtttgaattcattgtagattctggatattagtcctttgtcaaatgtatagattgtgaagattttctcccactctgtgtgttgtctgtttactctgctgactgttccttttgccctgcaaaagctctttagtttcattaggtcccagctatttatcttcatttttgttgcatttgctttcgggttcatggtcgtgaaatccttgcctaagccaatgtctagaagggtttgtctgatgttatcttgtagaatttttatggtttcaggacttaggtttaagtctttaatctatcttgagttgacttttgtataagatgagagacgaggatccagttttattctctgacatgtggctagccaattataccagcaccatttgttgaaaagggtgtcttttccctacttgatgtttttgtttgctctgtcaaagatcagttggctgtaagtatttgggtttatttctgggttctctattctgttccattggtctatgtgtctatttttataccagtaccatgctgcttcaatgactatggccttatagtatagtttgaaatcaggtagtgtgatgcctccagatttgttattttgcttagtcttgctttggctatgtgggctcttttttggttccatatgaattttagaattgtcaataaatgtgatataccacaaaaacagaattaaaaacaaaaatcacgtgatcatctcaatagatgcagaaaaagcatctgacaaaatccagcatcccttcatgattaaaactcttagcaaaatccacatacaagggacataccttaatgtaataaaagccatctatgagaaacccacagccaacataatactgaatggggaaaagttgaaagcattccctttcagaactggaacaagacaaggatgcccaccctcactactcctcttcagcctagtactggaagtcttagccagagccatcagacaagagaaagaaataaagggcatccaaatcagtaaagaggaagtcaaactgtcaccgattgctgacgatatgatcatttaccttgaaaaccttaaggactcctccagaaagctcctagagctgataaaagaattcagcaaagtttctggatacaagattaatgtacacaaatcagtagctcttctatacaccaacagtgaccaagcagagaatcaaatcaagaactcgaccccttttaaatagctacaaaagaaataaaatacttaggaatatacctaacaaaggagtcaaaagacctctacaaggaaaactacaaaacactgctgaaagaaatcatagacaacacaaacaaatggaaacacatcccatgttcatggatgggtagaatcaatattgtgaaaatgaccaatactgccaaaagcaatctacaaattcaatgcaaaccccaacaaaataccaccatcattcttcacagaattagaggtatttgtcttgataaacgctttcagttttataagtcaaactttttttcagttgtataatgttttcctaaattatatttttaattgatttccctttgttatttattgattttgatctctttcttaggaacataaattttctcaatctattttccacatgtcttttcttgtggtttataactgtcttcttcttttcttgttattctatatcagggaaaatgtcctgggtttgtcctctatatcacgaattcagtttctgtaataccgttactatgcttcactgtttgtaagactgtatttcagcctgcaatattaaatctattgtcatgtttccttgtctcactgcactctctatacatttttttctgactttaagtcaactcagcgttcatcatagtgtctcacgttttcatcatcactttcaactctcttactgagacgataatagagtatcagctttccaaaactgatttcagttcatgtggtccatctttctaaaaaaaagctgggttttggttttgttttgttactgttgtttttgcaacttgctacatccatgaaattaaaaatagaaaattttgtctagtgttatgtcagtatcaggtctaaatctgtgaaattttatttcccttaatagtcatgcaacagccattagaataattttcttaatttgcaaaacaaggagataagtggttagcctgtcctgtatctgatgcaaaatagtttttattgttattgttttgtaattatatctgttttgtgtaagatttctggtttgaggaagtcatatttatttcactgcccaattgtatgcccatggggagatctgtttttggatagtgttaagaattatttaagtccttcattagcagagatagcaaataaaaaactacattctccaaagaacatcgttaccacaactctctcaactaggaatgggattgattgtaaaatgagaggcattaatgagacagattagggaggacaggtaatacagtcctctcttatttttcaggaagacagtgaaaaaatttaacagatagatgaacagaaatccttaaggtccctttcctttttccctccatatctctgttgtccacactgcattctgcctcatagcctcatttatgctttagtaaatagaaattcttcctcaaattctgcagattaaagatttttagtttccaatgttgttgaaagtttgaaactttttcgagaatgtaatgtgtattgcaatggttgcagaacaaattaatagtcattatctgccatcataacttgaaaattcttaaataatacctgcaatgttcttaaggggaaaagtattatatgttccaaagactaattgacaaagactcttttggtacacaaataaatgaaattttgtagaccacctaccaatttttaaaattgttttgtactttcaattgcattttaaattccaataatattttatgtttatatttgcactccaaaataccaactaggatgttaatatctactctagatgacaaaatatatattcatagacaatgtcagagtttttgtttcatttcatgagctgtgcacagattaatttagttaatattgtgggaaaattaatatgtttgatccatgtgagtcattggtgatgaagtaatactatttaataatgtatttttatgctggctattttttatttgaactcactagatagaaggcgaagcttcctataagttaaacttcaatttttgtctgtatttatttattcctctgtgctaactgccattgattatctctttattaataggagaaaatgttgcactactcttaccaaggtagtaacagcacgtatcctaaaagaaaacccctatcactttgatttagctcaactgtatgcaacattgttgtgagtataattattcaaaagtcacagctgttgttcactgatttaggggacaaaaagtatttttccttcaaacttattttgttttctgaaggatattggtagaataagtgtatatttatatatactgtcaacaatttcagagctttcagaaacagattttttatggtatagacataaatgaaatttacttataatgtataccttatcggattaacaacagaatttgagaagtcctataaaaattgcgccagtgtggtgacctatgcctataatcccagcactttgggagtccacggcgggcaggtcgcttgagcccaggagttcaagaccagcctgggcaacatagtataaccccatctctacaaaaaatacaacaattagctgggcatgaagttgcatgcctatagtcccagcaactcgagaggctgaagtgggagtatcacttgagcctgagaggtcaaagctgcagtgagccgtggtcacagcactacactccaacctggggtctgagtgagatcctgtctaaaaaaaataatagataaaataagaaaagcactacaatataaagaaaaaaacattacaaattgttgaatctataagaaggtaacataacaatgacctggtgtaatagtttctgtcatttactagatattaaattttgctgaagaaaaatgtaaacaaaaaggtcttatgaatcttattagataataaaatgaaacttggagagatgctttgatctgcttaaaattttttaatattattaatataataatcccaaatggacttagacaattttcatacatttattgatgtattcaccttatttatttaaacatatatatatactgagcacttaatatgtaccagacatactttttttaagtggcagataatagtagacaaaaaaaatacaggtaaaaatctctgaccaaattaagcttatactttagtaggaaaaagagaaaacaaataaaaaggtaagatatttatgtttatgttgataaacgctaagaagaaaagtataggtattgcagattgggttggggggagtgtgagtgttcaaattaaaatatcataagaccttcttcccacctagacgagatcacaaaatactttctcatgtccatgtaattttgcctgccaacaaagttagcatttttgttacaaacagctttgaattcgttcacttgatttagcgaatggttgatgaagaggccagagtttcatattacagaatagggcgtgcatactatacatggaagacttgtaagtgcaggtgtagttagtgattcacctagaccagaggaaaatttcaatattgctcctgtggggaaataaaaaattcttattttgtgcaacatcatttcccaatggccagccagacttgagtcagctgctaagtgcacatcaaaataactacacaaattgctgcatgggcttcattggtattcacaaaatgacctttggaaaatatctacccaaaacaattttggttttggcatatttactaccatcctgtcatttccaaaagtaattggaaaatatgatcagttatttctagacacaattcctgtttcatgacattaagatcatttagtctgtattcaaaatgccattctctttgccatcacagaaggatatatatctaattaatccaaaagctgcatccgaaaatttaaatataacttaaggtaaaaggagactaaaatctagcttcattttacattgtatgacagtgaaactttatgtgataatccacatgaatatgaaaattcaagcttttataaacatgaatatcttatatgggtcaaagtataattttactttaaaaatatgacatgaaaatataaaatgaatgtatattaaagattttattcagcttattaattaatgaggtaaccacttagatggtaacactgactccaaaagcatttgataaaaaggggtttacatagtttatcaagatagccatctaaaaactttagagtaggactgccaggtcagatacaaattcattattgtcatttggggcaataaagtagcaaccacggaggttatatttttatcagatagaaattttaagttagctagtaacttcatagtgtctgagttgtgatcaagttgtaaatagcaaataggtatattctcctgaaaaaatatataatcctcaggtgcgctcattaaacaatgtctgagtaatattgaaaagatatgccacccaccttttttgtccttttttccagttttaataatttttaatcgtccccatgttttggtcataaataatctttgaacattgattagaaaaaaatggctgacctcattatagtttaatctgattattttcacagatacaacggtggtgttagctacatatgcttcctggattacatagtattcagcaactagcaaaaatattttgtttgtaaattgtatcaatgagtccagggttgaaccacttaaaaggatctatggcctttttattcatataggggttaggatgtcaaggccatgaaaatctctcccccagatttcactgtggtaataaccacagatttaataaagttctctctcctcaaggccccccaaatatactaaagttccttgcctgccaggaagtgaccttccttatcacttctgaagctgaagtcttgtaagacaggtaccagtacagtttcctgcgagggttttgtagtcatttgttgcctttgttccctaatgatgggcttgctgtaccagactaaaaatgattctttcccaaatatagcattggacaatcaatttgtctaatttgaggtaaaatggagacaaattcttattgaaacaatgaatataactattgtcacaaaacaaaaaaaaatcagtaaaaacatttgtttctgaattatgagatttcgattccattttaaaatgtttcatttccatttataaaagcataaaattctaaactgggaggaaaagatcaggaaagatcaatgactccttatatacttatcagtagaaaaagcattaaaacatcagccatattccaaatttcatgggtatagttcataaaataagaatagattttacatttttaaatgttcgaaaaaaattaaaatagtaataacattttgtgacatgaaaattatatgaaacttcaatgttcataaataaagttttattgaacacagccacacatactcatttacatattgtctatggcacttttgtactacaatgaccgagtagttgtgacagagacctgataacatgcaaagcctaaaataatcactatctaaaactgcagaaaaataaatgtgctgacttccgttctagagctcaataaagtcaacacaaagcactgaaaatagttctggtaagatactgaatctctgttctctgagcgaattacacagacagtaaactttttagtactccttattaaaagaagactaaaaacttcatgatcaattgtcattgtaatagaaagtcaaataaaagattcacaagctaatttcttttaaaattatgaataagcccatcgacattgcacaaaagttgtcaaaatgttaataattttcaatgcttctctttagctccattatatgcaattattgcaaaccaagacaaaatttccttgcttcaaaaattctgcaaatttctataatatccaggttttgtctttcattatcctctttcagattttggaacagatatcataatttacatactactctcatttttctttgataaacagaacttatcctattatctcgcatacattcttgtgcttttctgctatcattgatctcagtagaatctcagtttcacacagtaactatatcttttaaccagattaactaacttctttttcacaaacacacacaacaaacatggaagtggataattgataatcatctatcatacaacacaattagcagataagcaaagctcacaagctcatataacatggctaactaccactcacataacttatacaccttcaggtaagcaaagaatcttggaaattaaataatttccaattaaattccaaattaaacaaatacagacatccataagacaaaacataattactgctgacataaaaactttgtcagaagaataaacacatagtttcgtatttttctcaatcctaaatatcgtatagaaatacatttgcttaactaatcaataaattgatacaaaaagttttggaagttcagaattactggtcttttcataagaaaacaaaccaaatgtaatttaaaaatgagatgcattgcggccaaaaaacacatgaaaaaaggcttaacataactgatcattagagaaatacaaatcaaatccacaattagataccatctcatgccagtcagaatggtgattattaaaaagtcaggaaacaacagatgctattgaggttgtggagaaataggaacgcttttacactgttggtgggaatgtaaattagttcaaccattgtggaagacagtgtggtgattcctcaaagatttagaatcagaaataccatttggcccagcaatcccattaatgggtgtacacccaaaataaaataaatcattctattataaagatagatgcacgcttatgtttattgtggcactattcacaatagtaaagacatggaatcaacccaaatacccattaatgatagactggataaagaaaatgtgggccgggcgcggtggctcacgcttgtaatcccaacactttgggaggccaaggcgggcggatcacgaggtcaggagatcaagaccatactggttaacacggcgaaaccccgtctctaataaaaatacaacaaaattagccgggcgtggtggcgggcacctgtagtcccagctgctccggaggctgaggcaggagaatggcgtgaacccgcaggcggagcttgcagtgagccgagatcgcgccactggactccagcctgggcgacagagcaagactccgtctcaaaaaaaaaaaaagaaaaaagaaaatgtggtacatatacaccaatgaatactatgcaaccataaaaaggaacgagatcatgtcctttgcagggacatggatgaagctggaagccattacctcagcaaactaactcgggaacagaaaaccaaacaccacatgttctcacttgtaagtgggagctgaacagtgagaacacatggacacggggagggcagcaacacttgctggggcctgttgcgggagggcgagggtaggagagcattaggagagcatgctgggcttaatacctgggtgatgggttgataggtgccgcaggccaccatggcacacctgtgacatgacaaacctgcacattctgcacatgtaccccagaacttaattttaaaaaaagatgaattgattattttatacataccagttataaaaattagaggaaagtaatatagctgtattcaaaccagtctaatttgggcaaaactttactttgaatacatgaacttagtttcttgtgtaaacaagctcacaatttctattataaaagtttacttttctcttaaaaagctggtacatttaatgtctcaaatactttattttctgcaaatctctggggtagttaaatctagagatgcacttccaaatctctgtaaacccattaagataaagccccattaattttggagactgtataatctaattcaataataccctccagagatatgaaaatatttcaaatcggaaaaggcttttctcagttggatactctgacactgacagagtttacagtttcatttctccacttcacccaaaattcataaataaacatagacatataaaaagtatgtcttcagaaaacgaactgctgttttgggcactatgccaaattgctacaaggtgacttttgtttatggcttccgtggagtgagacaagcaggtggtaaccaggggctcctcaccactgggcccaatggggttaggggcagaagagccaagaccctggctgcagtccaagagaggtcaccaataacatcattttggaaacaccttttcattggacattgaaggttcatgccgaggcagcccctataaccttttattctgtaattcccattgatttctatcttttactacccatgttgttctggcggctttgtgaggcttattctgccttacttctggtgcactatctcttgaaaacaaaagccacagtatatgcatctgagacagagattcacaagggacctttctactagaaaaagagaagatggtgctgacacatacttgcttgaatttactaatgaggattctgagaaggaaacgactctgaccagtgcaagacagaacaccaatttagaattaagattttagtttccggttcagcctttattatgatatccaatgacaggtactgctagattgttttcggggatggttggcttcaagaatggggtgaaatatggcttattaaatttaccaccaggttgattttccaagccatttgtgaagctgtttctaaaggataacctctggagtcttgtgttcagatttcatagctagttagtttaaagaattaattttaccatctcatcaattttataatatttattgttaaatatctttgattaaaatttgaaggattatgatactatgctccatgtgtgttctgattcaaggattcatggttggtatgaaaatagaattggatttagagttgaatgctattaacactactcagagcaactgttacataactaaagcatttttcttatgcaaaatacaggtacatagatattctataggtaatattcaataagttgactggatgataaacagtttatctctctcttcagtagtgaataactgaatctaacaggataataatgaaatgaataacaaagctcataaaacatttactaaaatggtgttttctcatgttttgctttacatactattttagctgattccttctgatttaacccaggtaattttattgttatatttttaccatcatgattggcaatatatggggaatgttacatactacactatttttaactcacctagaaaaaagaaagccagattcacatggaatatgttttggttaagaaaatgcaatgctgaataaatgatttttttttgctgatcattacatgctgatcattacaatctgtttgcagaaattggtttgattcataatattatcaatctctttaagcaaaatataagtgaattatgtgatcataataataataaatgatccttctgtttttctaaaaaaataaatacctacttctggggtaaataagccagtgaaatttaggaattattaataatctaacaaagagaagcttctgtgcctacataagatacttaagaataactgcaagaaaagatgtacgaaatatatatgagtgacattgctaaaaggtaatgaaatacttcaatacattaaattaatggttaacaggattcaatatctaatattcaattgttcaaaatgcaattccaacaaatatccaaaaagtattttagtggatcctgagatccctgatcttgtgataactgaaaataaaacttacaggaaatggcgaaggggctggccaagttgcccctaaaaagaaaaaaataaaaggtggaagaaggcatctattctctcataaaatgagacttgatgccaatcaccagtaattaaaatgtgctgtactaacacagagatagacaagtgaagatggacacaaccttttgataatgtcctatttcataaatatgggggggtaggtgtcacaggtgttcattctattattgttttataataacatatatgttacatatattctttatgtttattatttatctattgctgcacattaccccaagtcttagtgggtcagtcattcaggagaagcttagtggcttggatctgcactcggggactttcatgaggcttggtcagatgtcagccagggctactgtcatcttaagaattgactggagatgaaaaatctatctgcaaggttcctcacactctatgctggtgatggctattggcaggaggcctgtttttccctgttgcacctgtcaatgatctgcttgagttttctcacgatgtatcggttggtttcccctagaagaagtgatacaagagaaagcaagatggaaaccacaatgccttttctgatctagacttggcgagtcacacacaatcaaacacctattcaatatgggagagaaataaacaagggcatatatacctagaacatgggtcactggggggcgggcatcttgaatattgttttcaacagtatgtttcatatattacattcacaaaattaatttaaaaaatgtttcttctgggtaacatcaggaagaccaattaatgtttcatatattttatctccctaattatgctgagtgctctgaaagaaagaatgtaactgttacaataattttgaggcattacctcactcacaagaaaaaatgccacagagcttatatacaatatttatttatgaactaaattttatgaaataaatttacctgaaatagttgggtaccttggtaaaacagggaaagtctcatatcttacatagccatatgttagtataatattacagagagtatttgcagcttttttgtttggggtttcaacacaaattttgctgcctaacaattcatcatttttgaggaatgtttcatttattccatctgtaatctatagtaagtgaatacaataaaatgataatattgcattactaggtaaactaactttgtatcgaaacactaatatattcaaatttgaaaggaacgttgcaatagaaacatgctgttattgtgtgtccaaagaatgatttagcaagtctcaatatttatttcgaaaacattaaagttaacattatttccctttcaaaaatgaatacaattattaagagtttgcatagttaatggaattttgcataccccacatagcatgttgatcagataaacctgattaagactatgtagtttagtaataacttttctatgttgatatagaagaaccgtcatctataagtcttcatgaattctttaggcagtcattttatttcaataaattaatttattcaatgactattaactaataaagtcatcaatttaaaagtgaagaaatacataaacttgttctaatcaactgcatcaccttgcattaaatctgagaaaataaaaactataggggagagcaccatttacctaaaatcagttaggaagtttttgagagtgaagattagattacaatttaataataagattggacattatgctaggtatttctgagatgcaaaaaattttctgctgcattccagatataaaacaattcaacaaggacacttacagagctctaattatggtccaggcactataattttaaaaatgaacagaattaaaatcctgctttccaggagatgaaagacatgatactgacatgaagaatagtaatatttacaaataatatatatgattaggagacttgcaaacaataactactataaaaatacaaatgtggaaagaaatgtgtgcctgaatatttgcaaggaaagtcttcaacgcagataggatatatgaattgggatttttggtggattagaaaaatttggattgttgcaagatagatttttgaaggacaatgacatgtcagatgttaatgaggcaattggtagtgggtgttgtcattgaggaagagggcaattggtgatttaggcacatgcatcaattttatttgtcacatttgacaacaattttgctattaaccgttttttgttttctttggaaacctgtttgaaatagttattatcctgttttagcaataagctgtttcttagaattctgtctagcacatgggaaacactcaataaatgttgctaaagatgactctaaatttcagaagatggaaggccttcaacttataaaaacaaatgccagtgtgcatatatatatgtatatatttgtatttgttgttcgtcattttttcctgtttttcttctaaaataatttaaaatcttttgttaagctccaaaattgttggtctttataaattgagtatacgttcattttttttctctttggtagatgaaccattatatcacgtctacttaagtaaaaaaagatatgattctctcatatatcttgtaaaaagatttaaagtaaaggagtataaggaaagaaaggcaaaataaagatggaaggaagggcaaagtttgatttgcataaagatattatttatttattttctatctacttttttttttttttttttgacagggcttcactctgtcacccaggctggagcacaggggcacaatctcggctcattgcagcctccacctcctggtttccagtgattctcccgtctcagcctcccaaatagctgagaccacaagcgtgcaccaccatgccaggataatttttgtgttttttgtagagatgtggtttcaccctgttgtccagggtggtctcaaactcctgacctcaagtcattcgcccatttcagcctcccaaagtgctaggaatggaggcgtgagccagtgcacctggcccctatctactttcaaaacaagataaacataataaaatctacttaccttgtaccatctaatattaagtgaaaagggaaaatattgtctttgtgttaagcatgctctgtctcttggattgtaagaggttctagggatttggaggctgataaaagagaaaggtatgtccatgagatggcagtagaacacagaagctatacagggtgataggtctgcattcagagaacgtccttcacagcacaagactgtccagaagctactggcacaggtcaatactcataaggtgaggaagacatgggaactccctcaggaaagggagtttggagagggggcttacatgtgtaggtgatatcactcagcagtgctgagtctcttggtcaaagagctctagaaggcagcaatggcttgggatcgtttaacctcaagatttacctaagctgtgtctagcagatgttggctgaggtttcatgaggtatgcaaagcgggtaggctcaaaatggctaaaaatctgcttctttgggttattgttaaaataaatggaatgtataaatatttgggtttggttccaggggccttttgagctagcaggtctcagcctgcagtgaagaaataaatgatacacagagtccatctttggttcatttatataggttagatattctgccttgcattggaggagccatgctacaggagaggctggctacagaaaccatctagtaccccaaatctcaaaggccttgttcatccggtaaagttacattaaaccagcttgaattttttcaagttgatcatattttataaactagttcactttactgtatgagatgagaaagattatgatatgcttatgatggccaattcatgttgtaacttggaagtaattattttagttgtaaatgtcgttatagctatatagttatatatgtgcacatatttatacatacacaagtgttttaaagaaagaggaagggacagatagagggaatattatctttaaatagtataaatggtcttactatcaagattttgctttgagacggaacatgtaatagatattttaaaaggataaaaataaaagatcaggtgacattagaaatagatatcaccaaacatgtaatttgtccagaataaggaaggactaagttagcttatttaaattagaactatggatatggggttggaacatagagttaaaagatctcaagagagaaggatatgcttcatcaaatattgaccctaagctaagactatacagaatttgcatcataccagaagaagcacagtgtaacgagcacagtcattcctcagtgggttgtatgtaaggaccagtcaagacaagaagagaagtagacagtgaaaactgcacaaaagttaaagtaatgtaacaaaaatcaatcgaaaataccatgaatgaatatataaaatgtttcttctctctatagaattcagtgaatttagtaaggctttaaattgccattcaaaataagccagtatataaaagcttaggtgatgatggttacaataactgccttcagtggatcaaatgggctcttagtggacaaggaatagttaattctactttccaaatgagtcacttgttagtagattgtactttatatccactgagataatctcactctaattctattaggtttgaagaattctaacttattcagaataataatgtgaggggaaattaactctgacacctttcaagcttaattttttaaagtaatttttgtagtgatattttagtgaggaatagtttgtaaagcattcctttttgaagataagatatggaagagcctctgaggaagataaatagttaaaatatccactcattctgtgtggttgcctgtagtcaaatataaatgagttcacttctgaagtgattgagtttcttgtaggtaaaatgtccttaaacaacattgccggtgctctcctgcttatagacaaaactcagcatcaactattttatttcagtggaatccaatttcattttaattgaaatatattatgtaaaaagttaataatccattgaagttgcaatttgctaaatggtaccctggtggcttaaattgtcaacatagcttcttaaaatatcgaatataccacaagggagtaatttttcccttgatgaaaccaattcagtatgtgggtaacattctagatattgtttgcctatgaagtctaatcagtttcttataaaagttcttttagtgaaaaaacaaatcaaaatccaagacttgtaagtaaaagagacatttctaccaattcttcaaatagaaaacaaatatgcattaaatttcattaactaacacacacacagactaacacacacacacagacacacacacacacacacacgcacacacacaaactatttgatctttgtccccacctcctggtacagaaatcctaaaccccttggaatttttgtgtgataaaggtaataggaatgtattttcttttaatgaggtaggaccctagataggtaggaccatggtaggaccctagatagctgaaggatagggtcggttgctagaaagaccaacccttggttaaaaagaagcttgtacttacagcctcaccttactcacctctggggaaaagagtggggcggaaggttgagttaatcaccaatggctataatcatgcctatgtaacgaaacctctgtaaaagcccctaaatgacaggctttggggaacttccaaattggtgaacacattcacatgccaggaaggtagcatactccaattccatggggacagaggctcctatgcttgagacccttctgcacctcattctacggacctcttaatttgaccgttcacttctatcctttataataaactgtaattgtaaatataatattttcctgagttctgtgaattattccagcaatttatcaaacttgaggaggggggttgtgggaacccctgacttcatagccaattaggaccaaaaaaggtgggatatttatgtgtgtgtgtgtgtgtgtgtgtgtgtgtgtgtgtatgtgtaatgtttttgtccacagtttctggctcaaaactcccataggcccttttacagtcttttgttatgatatcgaggtgctttaggccttaggagcaagcctcaagaaatagaatcttttactttcccctgttttccttttacctgctcaagataagactctaatctgattgtgggtcaagagatcctcattacagagagggtcctactctataacctggaggaaggaatgcttcacagagaggccaagaagaatctgaaaagacaggccttgctgagttttcccactcagtctattaggatgagaccatactatttttgtccaatcatatttctacattgttgcctatcatgcctatgtaatgaaacctccattaaaactcagaagaactgggttcctggagcttccagagagctaaacatgtgtaggctcctggagggtggtgtaaccagggagggcatgaaaactctgggttcagggagcttccagatagctcaacatgtggaggctgctggagggttgtgcacccagggagggcgtgaaagctctgtgccctttcccttacacctctccctatgcatctttttatctgcaccctttgcaatgttattataagacagtgaatgtaagtaagtgtttccctgagttctgtgagccactccagcaaattaatcacacccaaagagggaatagtaggaaccccagcctcaaggccagacagaatttctgaaggcccagacttgtgactgttaactgaagttaggagaagtcttgggaactgagtcctcaatctgtgcgatctgacactctgtctgggtagatagtattagaattgaattggtttatacccagctggtgcctgaagcttgtgggggtggaaaattccccacacatttggtcacaaaagttttcttctctgttgataactgttgtggcctaagagcagaggaaaaatgatttcagttgtttttcccaaacaagtgggtaaacaaggaacctgatacttctgactggcactgaaatgacggcagtcttatgtgacttagcccgtatcctatgaagtctgacactaactctggacagttagcctcagatttaaattgagttgaggacacctagttggtgtcagagaattgaagaagtaatgttgaaaaaataaaaatcacatactttgtttctggaaggaaaaaatatctcccatgctctctctatatatgtattaaagtattttaaagcatttagacctgagatttaagacctaaaagttaagatttaaaatttaatggtcctaaaacttgcactaaaatgataaaattgttctgtagtcaaatgtaattaatttagattccctgtcttaggatgacgtagaatcagaatattaacattggaaacatcttagaaaggcatagggaataggccaggcgcggtggctcatgcctgtaataccagcactttgggaggctgaggctggcggatcacaaggtcaggagttcgagactagcctggccaacatggtgaaaccctgtctctactaaaaatacaaaaattagccagtcgtggtggcatgcgcctgtagtcctggctactcaggaggctgagagagaagaatcacttgaacccaggaggcggaggttgcagtgaaccaagaccacgccattgcactccagcctgggcgacagagagagactccctctcaaaaaaaaaaaaaaaaaaaaaggcataggaaataacctgactgtgtcacagatgcaggtgcttaaataaaaaagattaaattacttgtttgaattaatatagctagaatgcttggaactggaactagagctcaaaactcccactctatagttatttgtcatcattctatgttagtcttcattgatatgtataatatattttaagacagcacatatttcacatatttcataacttaataaccacttgaaaacaaatacagtatccaaataaatttccaaaattagacaaaaattctttcagtcaagatgacagaccaaatatagagccttttctgttcttcctcctaggacaccattaaatggcagcaaataaatagaaaaaatacaaatacacagcagaaataatggaagaacagggatttctatgaattttctgcaagacaggatttcatgggctcatgaagcaatggaggagcacaaaactagaatatacatggagggcaatgtagccaaagagaaatttgatcttccaatcaaaatcggtaaaaaaattactcaaaaaatgaaagtcttaacctatacaagataaagtactaacatttgaaatgccagaaatattaattagaaaaatgataaaaattgcaatattcttttcctgcttactgcttctcccatggactatagaaaaataagttaggcagatgtgccaacgcaaaaactcttcagtggcaaaaatatttaattaaaggtgacacaaggcattgactacctcagaaaaagtgtgattatactctcagtgtattcaattcactgcaataagacatagaataaacacagaaagaagaataccgaagaataataccactgaattctttgcattgagataataatttttttgtaatggagtagaataccactgcctcattaagataatttttgtcattaggtgattctgtgaaggtttacttactcatcacttaatttttcattcacacctaaaaccaacattatttcttatccctgtattaaacaatactgggaccaggaatactttctttctctatcataaatactatactgatactaaggaaaagtatgttagctctcacaccaagaactgtctgtccctcaatgataaaaacaattaaccaaataaaaagagtttctatcaagactaacagcttgcttatcaatatttacttcaagcccctgcctcactgtgcctaccaatagaaagctattatgtcaaaaactctgtccactctcaaccagttccccacgttgcaagattcaccttaaaatcatccgtttcaggcctctaaaagctacaaacatcctttctttatttcaccgttttgagacattgctaagcctctgttaaggtgttcttttttaccacagtaaatttaatgaacttagatttgcttaatgaacagggatttctggtggtcttcacagaatgctcaaccaaagtatcctgacatcagtaactacataaacatttgttattgccttggtatatgccagggataccactgcaatttgaaagaaatgatactaaataagagcctttaccccagcttgaggcacatcctagaatgaatcattttcaggcatgaggatcttaatagcaaagtgttattctgcttttcttttatgctggacctgccctcacttacgggttgatacagtttggatctgtgtccccacccaaatctcatctcaaattgtaatccccaggatttgagggagggacctggtgggaggtgactggattatgtggggggacttcccccttgcagttctcatgatagtgagggagttctcacaagatttggttgtttaaaagtgtgtggcacttcccccttcattctctttctctcctgctccaccatggtaagacaggcttgcttccccttcaccttctgccatgatcataagtttcctgaagcctcccagtcatgcttcctgttaagcctgtggaactgtgagtcatttaaacctcatttttttcataaattactcagtctcaggtagttctttctagcagtgtgagaatggactaatccagaggtataatttaaaacttggaaataattgaccagattcagaggaactttggaaaactggctcatcttgactcatcagtttgtatccactctctatttcattttctcctaatcagaacattatggtactaatccagaaaattagaccatataatttaaaacatttttgtagtcatggacatatatttttgttgattcattcagttcagcctggtatacaatgctgagatgattggttaaatttggcacatagcttaaggccatataatagaatatactccattgatccgtagcagataattcaatctcattactattaattttttgccaactggcaaaatctccccagggtaaggtcatatttctggcttgtctgagttcatgaattttcatagtatttccagaaatagtctagcctcctaggaaaactgcaaaatagagcttggatgattggagtaataatagaaaagacacccttctcccctatgccaatgccaatttgcccaaaactaaaatggataacgagacatcaattttaggcttgaaattattcctgtgtcttatcctaattaattataagggga
